United States Patent
Compernolle et al.

(10) Patent No.: US 10,618,964 B2
(45) Date of Patent: *Apr. 14, 2020

(54) NANOBODY AGAINST IL-6R

(75) Inventors: Veerle Compernolle, Veldegem (BE); Francis Descamps, Roeselare (BE)

(73) Assignee: Ablynx N.V., Ghent-Zwijnaarde (BE)

( * ) Notice: Subject to any disclaimer, the term of this patent is extended or adjusted under 35 U.S.C. 154(b) by 165 days.

This patent is subject to a terminal disclaimer.

(21) Appl. No.: 13/263,223

(22) PCT Filed: Apr. 12, 2010

(86) PCT No.: PCT/EP2010/054747
§ 371 (c)(1),
(2), (4) Date: Mar. 22, 2012

(87) PCT Pub. No.: WO2010/115995
PCT Pub. Date: Oct. 14, 2010

(65) Prior Publication Data
US 2012/0171209 A1    Jul. 5, 2012

Related U.S. Application Data

(60) Provisional application No. 61/168,379, filed on Apr. 10, 2009.

(51) Int. Cl.
*A61K 39/395* (2006.01)
*C07K 16/28* (2006.01)

(52) U.S. Cl.
CPC ...... *C07K 16/2866* (2013.01); *C07K 2317/22* (2013.01); *C07K 2317/24* (2013.01); *C07K 2317/569* (2013.01); *C07K 2317/76* (2013.01); *C07K 2317/92* (2013.01)

(58) Field of Classification Search
None
See application file for complete search history.

(56) References Cited

U.S. PATENT DOCUMENTS

| | | | |
|---|---|---|---|
| 5,116,964 A | 5/1992 | Capon et al. | |
| 5,888,510 A | 3/1999 | Kishimoto et al. | |
| 6,261,560 B1 | 7/2001 | Tsujinaka et al. | |
| 6,664,374 B1 | 12/2003 | Saxinger | |
| 8,629,244 B2 | 1/2014 | Kolkman et al. | |
| 8,748,581 B2 * | 6/2014 | Beirnaert et al. | 530/387.1 |
| 8,962,805 B2 | 2/2015 | Beirnaert et al. | |
| 9,181,350 B2 | 11/2015 | Beirnaert et al. | |
| 9,273,150 B2 | 3/2016 | Beirnaert et al. | |
| 9,605,072 B2 | 3/2017 | Kolkman et al. | |
| 9,611,326 B2 | 4/2017 | Kolkman et al. | |
| 9,617,341 B2 | 4/2017 | Kolkman et al. | |
| 10,118,967 B2 | 11/2018 | Hoefman et al. | |
| 10,138,302 B2 | 11/2018 | Holz et al. | |
| 10,392,440 B2 | 8/2019 | Beirnaet et al. | |
| 2005/0089932 A1 | 4/2005 | Kolkman et al. | |
| 2005/0142635 A1 | 6/2005 | Tsuchiya et al. | |
| 2007/0036785 A1 | 2/2007 | Kishimoto et al. | |
| 2007/0280945 A1 * | 12/2007 | Stevens et al. | 424/145.1 |
| 2010/0125664 A1 | 8/2010 | Kolkman et al. | |
| 2010/0215664 A1 | 8/2010 | Kolkman et al. | |
| 2011/0243954 A1 | 10/2011 | Revets et al. | |
| 2012/0077731 A1 | 3/2012 | Beirnaert et al. | |
| 2012/0244158 A1 | 9/2012 | Brige et al. | |
| 2014/0212417 A1 | 7/2014 | Holz et al. | |

(Continued)

FOREIGN PATENT DOCUMENTS

| | | |
|---|---|---|
| CN | 1535728 A | 10/2004 |
| EP | 0 257 406 A2 | 3/1988 |

(Continued)

OTHER PUBLICATIONS

Robert et al. Tumor targeting with newly designed biparatopic antibodies directed against two different epitopes of the carcinoembryonic antigen (CEA). Int J Cancer. Apr. 12, 1999;81(2):285-91.*

Liautard et al. Epitope analysis of human IL-6 receptor gp80 molecule with monoclonal antibodies. Eur Cytokine Netw. May-Jun. 1994; 5(3):293-300.*

Lu et al. Acquired antagonistic activity of a bispecific diabody directed against two different epitopes on vascular endothelial growth factor receptor 2.. J Immunol Methods. Nov. 19, 1999;230(1-2):159-71.*

Boulanger et al., Hexameric structure and assembly of the interleukin-6/IL-6 alpha-receptor/gp130 complex. Science. Jun. 27, 2003;300(5628):2101-4. Erratum in: Science. Aug. 15, 2003;301(5635):918.

(Continued)

*Primary Examiner* — Dong Jiang
(74) *Attorney, Agent, or Firm* — Wolf, Greenfield & Sacks, P.C.

(57) ABSTRACT

The present invention relates to amino acid sequences that are directed against/and or that can specifically bind (as defined herein) Interleukin-6 Receptor (IL-6R), as well as to compounds or constructs, and in particular proteins and polypeptides, that comprise or essentially consist of one or more such amino acid sequences. In a specific aspect, the present invention provides amino acid sequences and polypeptides that are capable of binding to two or more different antigenic determinants, epitopes, parts, domains of IL-6R, also referred to as "multiparatopic" (such as e.g. "biparatopic" or "triparatopic", etc.) amino acid sequences and polypeptides. The invention also relates to nucleic acids encoding such amino acid sequences and polypeptides, methods for preparing such amino acid sequences and polypeptides, host cells expressing or capable of expressing such amino acid sequences or polypeptides, compositions, and in particular to pharmaceutical compositions, that comprise such amino acid sequences, polypeptides, nucleic acids and/or host cells and to uses of such amino acid sequences or polypeptides, nucleic acids, host cells and/or compositions, in particular for prophylactic, therapeutic or diagnostic purposes.

4 Claims, 8 Drawing Sheets
Specification includes a Sequence Listing.

(56) References Cited

U.S. PATENT DOCUMENTS

| | | | |
|---|---|---|---|
| 2014/0221623 | A1 | 8/2014 | Kolkman et al. |
| 2014/0329278 | A1 | 11/2014 | Beirnaert et al. |
| 2014/0343257 | A1 | 11/2014 | Beirnaert et al. |
| 2014/0348830 | A1 | 11/2014 | Beirnaert et al. |
| 2014/0349342 | A1 | 11/2014 | Kolkman et al. |
| 2015/0037338 | A1 | 2/2015 | Beirnaert et al. |
| 2015/0050268 | A9 | 2/2015 | Holz et al. |
| 2016/0326252 | A1 | 11/2016 | Hoefman et al. |
| 2016/0333099 | A1 | 11/2016 | Beirnaert et al. |
| 2018/0016342 | A1 | 1/2018 | Kolkman et al. |
| 2019/0119392 | A1 | 4/2019 | Hoefman et al. |
| 2019/0119393 | A1 | 4/2019 | Holz et al. |

FOREIGN PATENT DOCUMENTS

| | | |
|---|---|---|
| EP | 0 312 996 A2 | 4/1989 |
| EP | 0 325 474 A2 | 7/1989 |
| EP | 0 409 607 A2 | 1/1991 |
| EP | 0 411 946 A2 | 2/1991 |
| EP | 0 527 809 B1 | 2/1993 |
| EP | 0 572 118 A1 | 12/1993 |
| EP | 0 628 639 B1 | 12/1994 |
| EP | 0 409 607 B1 | 10/1996 |
| JP | 2000/500644 | 1/2000 |
| WO | WO 97/13781 A2 | 4/1997 |
| WO | WO 2005/003345 A2 | 1/2005 |
| WO | WO 2006/023144 A2 | 3/2006 |
| WO | WO 2006/079372 A1 | 8/2006 |
| WO | WO 2007/042289 A2 | 4/2007 |
| WO | WO 2007/104529 A2 | 9/2007 |
| WO | WO 2008/020079 A1 | 2/2008 |
| WO | WO 2008/028977 A2 | 3/2008 |
| WO | WO 2008/071685 A1 | 6/2008 |
| WO | WO 2008/074840 A2 | 6/2008 |
| WO | WO 2008/077945 A2 | 7/2008 |
| WO | WO 2009/004065 A2 | 1/2009 |
| WO | WO 2009/010539 A2 | 1/2009 |
| WO | WO 2009/095489 A2 | 8/2009 |
| WO | WO 2010/100135 A1 | 9/2010 |
| WO | WO 2010/115995 A2 | 10/2010 |
| WO | WO 2010/115998 A2 | 10/2010 |
| WO | WO 2011/026945 A1 | 3/2011 |
| WO | WO 2011/026948 A1 | 3/2011 |
| WO | WO 2011/098518 A2 | 8/2011 |
| WO | WO 2012/064627 A2 | 5/2012 |
| WO | WO 2013/041722 A1 | 3/2013 |
| WO | WO 2016/062766 A1 | 4/2016 |

OTHER PUBLICATIONS

Campbell et al., Essential role for interferon-gamma and interleukin-6 in autoimmune insulin-dependent diabetes in NOD/Wehi mice. J Clin Invest. Feb. 1991;87(2):739-42.

Choy et al., Therapeutic benefit of blocking interleukin-6 activity with an anti-interleukin-6 receptor monoclonal antibody in rheumatoid arthritis: a randomized, double-blind, placebo-controlled, dose-escalation trial. Arthritis Rheum. Dec. 2002;46(12):3143-50.

Gaillard et al., Identification of a novel antigenic structure of the human receptor for interleukin-6 involved in the interaction with the glycoprotein 130 chain. Immunology. Sep. 1996;89(1):135-41.

Grau et al., Interleukin 6 production in experimental cerebral malaria: modulation by anticytokine antibodies and possible role in hypergammaglobulinemia. J Exp Med. Nov. 1, 1990;172(5):1505-8.

Hirano et al., Purification to homogeneity and characterization of human B-cell differentiation factor (BCDF or BSFp-2). Proc Natl Acad Sci U S A. Aug. 1985;82(16):5490-4.

Holliger et al., Engineered antibody fragments and the rise of single domains. Nat Biotechnol. Sep. 2005;23(9):1126-36.

Ishihara et al., IL-6 in autoimmune disease and chronic inflammatory proliferative disease. Cytokine Growth Factor Rev. Aug.-Oct. 2002;13(4-5):357-68.

Ito et al., A pilot randomized trial of a human anti-interleukin-6 receptor monoclonal antibody in active Crohn's disease. Gastroenterology. Apr. 2004;126(4):989-96.

Jilka et al., Increased osteoclast development after estrogen loss: mediation by interleukin-6. Science. Jul. 3, 1992;257(5066):88-91.

Kipriyanov, Generation of bispecific and tandem diabodies. Methods Mol Biol. 2009;562:177-93.

Nishimoto et al., Humanized anti-interleukin-6 receptor antibody treatment of multicentric Castleman disease. Blood. Oct. 15, 2005;106(8):2627-32. Epub Jul. 5, 2005.

Revets et al., Nanobodies as novel agents for cancer therapy. Expert Opin Biol Ther. Jan. 2005;5(1):111-24.

Roodman et al., Interleukin 6. A potential autocrine/paracrine factor in Paget's disease of bone. J Clin Invest. Jan. 1992;89(1):46-52.

Saito et al., Preparation of monoclonal antibodies against the IL-6 signal transducer, gp130, that can inhibit IL-6-mediated functions. J Immunol Methods. Aug. 9, 1993;163(2):217-23.

Shinkura et al., In vivo blocking effects of a humanized antibody to human interleukin-6 receptor on interleukin-6 function in primates. Anticancer Res. Mar.-Apr. 1998;18(2A):1217-21.

Starnes et al., Anti-IL-6 monoclonal antibodies protect against lethal *Escherichia coli* infection and lethal tumor necrosis factor-alpha challenge in mice. J Immunol. Mar. 15, 1992;148(6):1968.

Strassmann et al., Evidence for the involvement of interleukin 6 in experimental cancer cachexia. J Clin Invest. May 1992;89(5):1681-4.

Taga et al., Interleukin-6 triggers the association of its receptor with a possible signal transducer, gp130. Cell. Aug. 11, 1989;58(3):573-81.

Vierboom et al., Preclinical evaluation of anti-rheumatic drugs in a non-human primate model of arthritic disease. Drug Discovery Today: Disease Models. 2008; 30(20):e1-7. doi.10.1016/j.ddmod.2008.06.003.

Yamasaki et al., Cloning and expression of the human interleukin-6 (BSF-2/IFN beta 2) receptor. Science. Aug. 12, 1988;241(4867):825-8.

Atreya et al., Blockade of interleukin 6 trans signaling suppresses T-cell resistance against apoptosis in chronic intestinal inflammation: evidence in crohn disease and experimental colitis in vivo. Nat Med. May 2000;6(5):583-8. Erratum in: Nat Med. Nov. 2010;16(11):1341.

Bataille et al., Biologic effects of anti-interleukin-6 murine monoclonal antibody in advanced multiple myeloma. Blood. Jul. 15, 1995;86(2):685-91.

Beck et al., Brief report: alleviation of systemic manifestations of Castleman's disease by monoclonal anti-interleukin-6 antibody. N Engl J Med. Mar. 3, 1994;330(9):602-5.

Becker et al., TGF-beta suppresses tumor progression in colon cancer by inhibition of IL-6 trans-signaling. Immunity. Oct. 2004;21(4):491-501.

Doganci et al., The IL-6R alpha chain controls lung CD4+CD25+ Treg development and function during allergic airway inflammation in vivo. J Clin Invest. Feb. 2005;115(2):313-25.

Emilie et al., Cytokines in HIV infection. Int J Immunopharmacol. May-Jun. 1994;16(5-6):391-6.

Emilie et al., Administration of an anti-interleukin-6 monoclonal antibody to patients with acquired immunodeficiency syndrome and lymphoma: effect on lymphoma growth and on B clinical symptoms. Blood. Oct. 15, 1994;84(8):2472-9.

Hirano et al., Interleukin 6 and its receptor in the immune response and hematopoiesis. Int J Cell Cloning. Jan. 1990;8 Suppl 1:155-66; discussion 166-7.

Hirano et al., Biological and clinical aspects of interleukin 6. Immunol Today. Dec. 1990;11(12):443-9.

Ishihara et al., Molecular basis of the cell specificity of cytokine action. Biochim Biophys Acta. Nov. 11, 2002;1592(3):281-96.

Jang et al., Pharmacokinetic/pharmacodynamic (PK/PD) modeling and trial simulations to guide dose selection with CNTO 328, a chimeric anti-IL-6 monoclonal antibody (MAb), in patients with renal cell carcinoma (RCC). Journal of Clinical Oncology, 2004 ASCO Annual Meeting Proceedings. Jul. 15, 2004; 22(14S):2608. Abstract Only.

(56) References Cited

OTHER PUBLICATIONS

Kalai et al., Participation of two Ser-Ser-Phe-Tyr repeats in interleukin-6 (IL-6)-binding sites of the human IL-6 receptor. Eur J Biochem. Jun. 15, 1996;238(3):714-23.
Klein et al., Murine anti-interleukin-6 monoclonal antibody therapy for a patient with plasma cell leukemia. Blood. Sep. 1, 1991;78(5):1198-204.
Lederman et al., A single amino acid substitution in a common African allele of the CD4 molecule ablates binding of the monoclonal antibody, OKT4. Mol Immunol. Nov. 1991;28(11):1171-81.
Li et al., beta-Endorphin omission analogs: dissociation of immunoreactivity from other biological activities. Proc Natl Acad Sci U S A. Jun. 1980;77(6):3211-4.
Nowell et al., Soluble IL-6 receptor governs IL-6 activity in experimental arthritis: blockade of arthritis severity by soluble glycoprotein 130. J Immunol. Sep. 15, 2003;171(6):3202-9.
Prabhakar et al., Correlation of serum CNTO 328-Anti IL-6 monoclonal antibody (MAb) concentrations and biomarker expression in renal cell carcinoma (RCC) patients. Journal of Clinical Oncology, 2004 ASCO Annual Meeting Proceedings. Jul. 15, 2004;22(14S):2560. Abstract Only.
Roodman et al., Interleukin-6: an osteotropic factor? J Bone Miner Res. May 1992;7(5):475-8.
Wendling et al., Treatment of severe rheumatoid arthritis by anti-interleukin 6 monoclonal antibody. J Rheumatol. Feb. 1993;20(2):259-62.
Woo et al., Open label phase II trial of single, ascending doses of MRA in Caucasian children with severe systemic juvenile idiopathic arthritis: proof of principle of the efficacy of IL-6 receptor blockade in this type of arthritis and demonstration of prolonged clinical improvement. Arthritis Res Ther. 2005;7(6):R1281-8. Epub Sep. 15, 2005.
Zaki et al., CNTO 328, a monoclonal antibody to IL-6, inhibits human tumor-induced cachexia in nude mice. Int J Cancer. Sep. 10, 2004;111(4):592-5.
[No Author Listed], Ablynx Reports Positive Phase I Data for ALX-0061 in Rheumatoid Arthritis. Press release. Ablynx. Ghent, Belgium. Nov. 30, 2011.
Ali et al., Improvements in the cell-free production of functional antibodies using cell extract from protease-deficient *Escherichia coli* mutant. J Biosci Bioeng. Feb. 2005;99(2):181-6.
Colman, Effects of amino acid sequence changes on antibody-antigen interactions. Res Immunol. Jan. 1994;145(1):33-6.
Decanniere et al., A single-domain antibody fragment in complex with RNase A: non-canonical loop structures and nanomolar affinity using two CDR loops. Structure. Apr. 15, 1999;7(4):361-70.
Desgeorges et al., Concentrations and origins of soluble interleukin 6 receptor-alpha in serum and synovial fluid. J Rheumatol. Aug. 1997;24(8):1510-6.
Desmyter et al., Antigen specificity and high affinity binding provided by one single loop of a camel single-domain antibody. J Biol Chem. Jul. 13, 2001;276(28):26285-90. Epub May 7, 2001.
Desmyter et al., Crystal structure of a camel single-domain VH antibody fragment in complex with lysozyme. Nat Struct Biol. Sep. 1996;3(9):803-11.
Frankel et al., Characterization of diphtheria fusion proteins targeted to the human interleukin-3 receptor. Protein Eng. Aug. 2000;13(8):575-81.
Frey et al., Population pharmacokinetic analysis of tocilizumab in patients with rheumatoid arthritis. J Clin Pharmacol. Jul. 2010;50(7):754-66. doi: 10.1177/0091270009350623. Epub Jan. 23, 2010.
Grogg et al., HIV infection and lymphoma. J Clin Pathol. Dec. 2007;60(12):1365-72.
Hibi et al., Molecular cloning and expression of an IL-6 signal transducer, gp130. Cell. Dec. 21, 1990;63(6):1149-57.
Hinton et al., An engineered human IgG1 antibody with longer serum half-life. J Immunol. Jan. 1, 2006;176(1):346-56.
Holt et al., Domain antibodies: proteins for therapy. Trends Biotechnol. Nov. 2003;21(11):484-90.
Houdebine, Production of pharmaceutical proteins by transgenic animals. Comp Immunol Microbiol Infect Dis. Mar. 2009;32(2):107-21. doi: 10.1016/j.cimid.2007.11.005. Epub Feb. 19, 2008.
Imazeki et al., IL-6 functions in cynomolgus monkeys blocked by a humanized antibody to human IL-6 receptor. Int J Immunopharmacol. Jul. 1998;20(7):345-57.
Jones et al., Replacing the complementarity-determining regions in a human antibody with those from a mouse. Nature. May 29-Jun. 4, 1986;321(6069):522-5.
Jones et al., Therapeutic strategies for the clinical blockade of IL 6/gp130 signaling. J Clin Invest. Sep. 2011;121(9):3375-83. doi: 10.1172/JCI57158. Epub Sep. 1, 2011.
Ko et al., Production of antibodies in plants: approaches and perspectives. Curr Top Microbiol Immunol. 2009;332:55-78. doi: 10.1007/978-3-540-70868-1_4.
Levi et al., Effect of tocilizumab exposure on IL-6 and IL-6 receptor levels in patients with rheumatoid arthritis: graphical analysis of pooled data from four phase 3 clinical trials. Ann Rheum Dis. 2008;67(Suppl II):192. Abstract THU0176.
Levi et al., Effect of tocilizumab exposure on IL-6 and IL-6 receptor levels in patients with rheumatoid arthritis: graphical analysis of pooled data from four phase 3 clinical trials. Presentation EULAR conference. Jun. 11-14, 2008.
Levi et al., Reduction in inflammatory biomarkers with increasing exposure to the IL-6 inhibitor, tocilizumab, in patients with rheumatoid arthritis: Graphical analysis of pooled data. Ann Rheum Dis. 2008;67(Suppl II):192. Abstract THU0177.
Merk et al., Cell-free expression of two single-chain monoclonal antibodies against lysozyme: effect of domain arrangement on the expression. J Biochem. Feb. 1999;125(2):328-33.
Mihara et al., Humanized antibody to human interleukin-6 receptor inhibits the development of collagen arthritis in cynomolgus monkeys. Clin Immunol. Mar. 2001;98(3):319-26.
Muyldermans et al., Unique single-domain antigen binding fragments derived from naturally occurring camel heavy-chain antibodies. J Mol Recognit. Mar.-Apr. 1999;12(2):131-40.
Nishimoto et al., Interleukin 6: from bench to bedside. Nat Clin Pract Rheumatol. Nov. 2006;2(11):619-26. Erratum in: Nat Clin Pract Rheumatol. Dec. 2006;2(12):691.
Nishimoto et al., Mechanisms and pathologic significances in increase in serum interleukin-6 (IL-6) and soluble IL-6 receptor after administration of an anti-IL-6 receptor antibody, tocilizumab, in patients with rheumatoid arthritis and Castleman disease. Blood. Nov. 15, 2008;112(10):3959-64. doi: 10.1182/blood-2008-05-155846. Epub Sep. 10, 2008.
Nishimoto et al., Toxicity, pharmacokinetics, and dose-finding study of repetitive treatment with the humanized anti-interleukin 6 receptor antibody MRA in rheumatoid arthritis. Phase I/II clinical study. J Rheumatol. Jul. 2003;30(7):1426-35.
Nishimoto et al., Treatment of rheumatoid arthritis with humanized anti-interleukin-6 receptor antibody: a multicenter, double-blind, placebo-controlled trial. Arthritis Rheum. Jun. 2004;50(6):1761-9.
Paul, Fundamental immunology, 3rd Edition, 1993:292-295, under the heading "Fv structure and diversity in three dimensions.".
Rajpal et al., A general method for greatly improving the affinity of antibodies by using combinatorial libraries. Proc Natl Acad Sci U S A. Jun. 14, 2005;102(24):8466-71. Epub Jun. 6, 2005.
Riechmann et al., Single domain antibodies: comparison of camel VH and camelised human VH domains. J Immunol Methods. Dec. 10, 1999;231(1-2):25-38.
Riechmann, Rearrangement of the former VL interface in the solution structure of a camelised, single antibody VH domain. J Mol Biol. Jun. 28, 1996;259(5):957-69.
Roitt et al., Immunology. 5th edition. 1998;80-81, 107. (translation of 110-111, 150 from Russian-language version of Roitt et al., Immunology).
Rose-John et al., Interleukin-6 biology is coordinated by membrane-bound and soluble receptors: role in inflammation and cancer. J Leukoc Biol. Aug. 2006;80(2):227-36. Epub May 17, 2006.
Rudikoff et al., Single amino acid substitution altering antigen-binding specificity. Proc Natl Acad Sci U S A. Mar. 1982;79(6):1979-83.

(56) References Cited

OTHER PUBLICATIONS

Sato et al., Reshaping a human antibody to inhibit the interleukin 6-dependent tumor cell growth. Cancer Res. Feb. 15, 1993;53(4):851-6.

Scheller et al., Interleukin-6 and its receptor: from bench to bedside. Med Microbiol Immunol. Dec. 2006;195(4):173-83. Epub May 31, 2006.

Schmitt et al., Disease-drug-drug interaction involving tocilizumab and simvastatin in patients with rheumatoid arthritis. Clin Pharmacol Ther. May 2011;89(5):735-40. doi: 10.1038/clpt.2011.35. Epub Mar. 23, 2011. Erratum in: Clin Pharmacol Ther. Sep. 2011;90(3):479.

Smolen et al., OPTION Investigators. Effect of interleukin-6 receptor inhibition with tocilizumab in patients with rheumatoid arthritis (OPTION study): a double-blind, placebo-controlled, randomised trial. Lancet. Mar. 22, 2008;371(9617):987-97. doi: 10.1016/S0140-6736(08)60453-5.

Spinelli et al., The crystal structure of a llama heavy chain variable domain. Nat Struct Biol. Sep. 1996;3(9):752-7.

Tanaka et al., Targeting interleukin-6: all the way to treat autoimmune and inflammatory diseases. Int J Biol Sci. 2012;8(9):1227-36. doi: 10.7150/ijbs.4666. Epub Oct. 24, 2012.

Tijink et al., Improved tumor targeting of anti-epidermal growth factor receptor Nanobodies through albumin binding: taking advantage of modular Nanobody technology. Mol Cancer Ther. Aug. 2008;7(8):2288-97. doi: 10.1158/1535-7163.MCT-07-2384.

Usón et al., Soluble interleukin 6 (IL-6) receptor and IL-6 levels in serum and synovial fluid of patients with different arthropathies. J Rheumatol. Nov. 1997;24(11):2069-75.

Wesolowski et al., Single domain antibodies: promising experimental and therapeutic tools in infection and immunity. Med Microbiol Immunol. Aug. 2009;198(3):157-74. doi: 10.1007/s00430-009-0116-7. Epub Jun. 16, 2009.

Yokota et al., Phase 2 trials of anti-IL6 receptor antibody (MRA) for systemic onset juvenile idiopathic arthritis. Autoimmune Rev. 2004;3:599-600.

Zhang et al., Clinical pharmacology of tocilizumab for the treatment of patients with rheumatoid arthritis. Expert Rev Clin Pharmacol. Sep. 2011;4(5):539-58. doi: 10.1586/ecp.11.33.

[No Author Listed], Ablynx initiates Phase I bioavailability study with subcutaneous formulation of its anti-IL-6R Nanobody partnered with AbbVie. GlobeNewswire. Apr. 23, 2014, 3pp.

[No Author Listed], Ablynx's anti-IL-6R Nanobody partnered with AbbVie demonstrates a bioavailability of more than 80% after subcutaneous injection. GlobeNewswire. Oct. 23, 2014; 3pp.

Brorson et al., Mutational analysis of avidity and fine specificity of anti-levan antibodies. J Immunol. Dec. 15, 1999;163(12):6694-701.

Brummell et al., Probing the combining site of an anti-carbohydrate antibody by saturation-mutagenesis: role of the heavy-chain CDR3 residues. Biochemistry. Feb. 2, 1993;32(4):1180-7.

David et al., A study of the structural correlates of affinity maturation: antibody affinity as a function of chemical interactions, structural plasticity and stability. Mol Immunol. Feb. 2007;44(6):1342-51. Epub Jul. 18, 2006.

De Bruyn et al., Anti-IL-6 receptor nanobody (ALX-0061) seamless first-in-human phas I/II POC study in patients with active RA on stable MTX treatment. Arthritis & Rheumatism. Oct. 1, 2012; 64(10) Suppl.: S561.

Holz et al., Twenty-four weeks of treatment with a novel anti-IL-6 receptor Nanobody (R) (ALX-0061) resulted in 84% ACR20 improvement and 58% DAS28 remission in a phase I/II study in RA. Annals of the Rheumatic Diseases. Jun. 2013; 72(suppl 3): 64. & Annual European Congress of Rheumatology (EULAR). Madrid, Spain. Jun. 12-15, 2013.

Kaufman et al., Transgenic analysis of a 100-kb human beta-globin cluster-containing DNA fragment propagated as a bacterial artificial chromosome. Blood. Nov. 1, 1999;94(9):3178-84. Erratum in: Blood Feb. 1, 2000;95(3):744.

Kobayashi et al., Tryptophan H33 plays an important role in pyrimidine (6-4) pyrimidone photoproduct binding by a high-affinity antibody. Protein Eng. Oct. 1999;12(10):879-84.

Murakami et al., The value of blocking IL-6 outside of rheumatoid arthritis: current perspective. Curr Opin Rheumatol. May 2011;23(3):273-7. doi: 10.1097/BOR.0b013e3283456797.

Nakashima et al., Drug delivery options to increase patient adherence and satisfaction in the management of rheumatoid arthritis—focus on subcutaneous tocilizumab. Drug Des Devel Ther. Jul. 4, 2014;8:913-9. doi: 10.2147/DDDT.S52099. eCollection 2014.

Nishimoto, Interleukin-6 as a therapeutic target in candidate inflammatory diseases. Clin Pharmacol Ther. Apr. 2010;87(4):483-7. doi: 10.1038/clpt.2009.313. Epub Feb. 24, 2010.

Tanaka et al., Therapeutic targeting of the interleukin-6 receptor. Annu Rev Pharmacol Toxicol. 2012;52:199-219. doi:10.1146/annurev-pharmtox-010611-134715. Epub Sep. 9, 2011.

Wang et al., Rapid analysis of gene expression (RAGE) facilitates universal expression profiling. Nucleic Acids Res. Dec. 1, 1999;27(23):4609-18.

Yau et al., Affinity maturation of a V(H)H by mutational hotspot randomization. J Immunol Methods. Feb. 2005;297(1-2):213-24. Epub Jan. 20, 2005.

Almagro et al., Antibody engineering: humanization, affinity maturation and selection techniques. Therapeutic Monoclonal Antibodies: From Bench to Clinic. Oct. 1, 2009;311-334.

Neurath et al., IL-6 signaling in autoimmunity, chronic inflammation and inflammation-associated cancer. Cytokine Growth Factor Rev. Apr. 2011;22(2):83-9. doi: 10.1016/j.cytogfr.2011.02.003. Epub Mar. 5, 2011.

Ogata et al., Advances in interleukin-6 therapy. Jpn J Clin Pathol. Apr. 1999;47(4):321-6.

Trikha et al., Targeted anti-interleukin-6 monoclonal antibody therapy for cancer: a review of the rationale and clinical evidence. Clin Cancer Res. Oct. 15, 2003;9(13):4653-65.

Gratacos et al., Serum cytokines (IL-6, TNF-alpha, IL-lbeta and IFN-gamma) in ankylosing spondylitis: a close correlation between serum IL-6 and disease activity and severity. Br J Rheumatol. Oct. 1994;33(10):927-31.

Holz et al., Developing Nanobodies®: from bench to bedside. Internet citation. Jun. 24, 2008. pp. 1-37. Retrieved from the internet http://www.pda.org/Presentation/2008/PDAEBEDublin/holzjosefin.asp.

Martin, Protein Sequence and Structure Analysis of Antibody Variable Domains. In: Antibody Engineering Lab Manual (Ed.: Duebel, Kontermann, Springer-Verlag, Heidelberg). Chapter 3. 2010. 33-51.

Roovers et al., Efficient inhibition of EGFR signaling and of tumour growth by antagonistic anti-EFGR Nanobodies. Cancer Immunol Immunother. Mar. 2007;56(3):303-317.

Roovers et al., Nanobodies in therapeutic applications. Curr Opin Mol Ther. Aug. 2007;9(4):327-35.

Schoels et al., Blocking the effects of interleukin-6 in rheumatoid arthritis and other inflammatory rheumatic diseases: systematic literature review and meta-analysis informing a consensus statement. Ann Rheum Dis. Apr. 2013;72(4):583-9. doi: 10.1136/annrheumdis-2012-202470. Epub Nov. 10, 2012.

[No Author Listed], Ablynx's anti-IL-6R Nanobody, ALX-0061, shows excellent 24 week safety and efficacy results in a phase II clinical trial in rheumatoid arthritis. Feb. 13, 2013. Ghent, Belgium.

[No Author Listed], Compelling topline results from the Phase IIb combination therapy study of vobarilizumab, ALX-0061 9anti-IL-6R), in patients with moderate to severe RA. Presentation by Ablynx, Aug. 9, 2016.

[No Author Listed], Topline results from the Phase IIb monotherapy study of vobarilizumab. ALX-0061 (anti-IL-6R), in patients with moderate to severe RA. Presentation by Ablynx, Jul. 7, 2016.

Hosea et al., Prediction of human pharmacokinetics from preclinical information: comparative accuracy of quantitative prediction approaches. J Clin Pharmacol. May 2009;49(5):513-33.doi:10.1177/0091270009333209. Epub Mar. 19, 2009.

Van Roy et al., The preclinical pharmacology of the high affinity anti-IL-6R Nanobody® ALX-0061 supports its clinical development in rheumatoid arthritis. Arthritis Res Ther. May 20, 2015;17:135. doi: 10.1186/s13075-015-0651-0.

\* cited by examiner

MLAVGCALLAALLAAPGAALAPRRCPAQEVARGVLTSIPGATVTLICPGKEAAGNATIHWVYSGSQSREWTT
TGNTLVLRAVQVNDTGHYLCFLDDHLVGTVPLLVDVPPEEPQLSCFRKSPLSNVVCEWGPRSTPSLTTKAVLL
VRKFQNSPAEDFQEPCQYSQESQKFSCQLAVPEGDSSFYIVSMCVASSVGSKFSKTQTFQGGILQPDPPANI
TVTAVARNPRWLSVTWQDPHSWNSSFYRLRFELRYRAERSKTFTTWMVKDLQHHCVIHDAWSGLRHVVQ
LRAQEEFGQGEWSEWSPEAMGTPWTGGSHHHHHH    (SEQ ID NO: 131)

Figure 1

NANOBODY AGAINST IL-6R

RELATED APPLICATIONS

This application is a national stage filing under 35 U.S.C. § 371 of international application PCT/EP2010/054747, filed Apr. 12, 2010, which was published under PCT Article 21(2) in English, and claims the benefit under 35 U.S.C. § 119(e) of U.S. provisional application Ser. No. 61/168,379, filed Apr. 10, 2009, the disclosure of which is incorporated by reference herein in its entirety.

FIELD OF THE INVENTION

The present invention relates to amino acid sequences that are directed against/and or that can specifically bind (as defined herein) Interleukin-6 Receptor (IL-6R), as well as to compounds or constructs, and in particular proteins and polypeptides, that comprise or essentially consist of one or more such amino acid sequences (also referred to herein as "amino acid sequences of the invention", "compounds of the invention", "constructs of the invention" and "polypeptides of the invention", respectively).

The invention also relates to nucleic acids encoding such amino acid sequences and polypeptides (also referred to herein as "nucleic acids of the invention" or "nucleotide sequences of the invention"); to methods for preparing such amino acid sequences and polypeptides; to host cells expressing or capable of expressing such amino acid sequences or polypeptides; to compositions, and in particular to pharmaceutical compositions, that comprise such amino acid sequences, polypeptides, nucleic acids and/or host cells; and to uses of such amino acid sequences or polypeptides, nucleic acids, host cells and/or compositions, in particular for prophylactic, therapeutic or diagnostic purposes, such as the prophylactic, therapeutic or diagnostic purposes mentioned herein.

Other aspects, embodiments, advantages and applications of the invention will become clear from the further description herein.

BACKGROUND ART

The interaction of IL-6, a protein originally identified as a B cell differentiation factor (Hirano et al., 1985, Proc. Natl. Acad. Sci. USA, 82: 5490-4; EP 0257406), with IL-6R (Yamasaki et al., 1988, Science, 241: 825-8; EP 0325474) results in the formation of the IL-6/IL-6R complex. This complex binds to gp130 (Taga et al., 1989, Cell, 58: 573-81; EP 0411946), a membrane protein on a target cell, which transmits various physiological actions of IL-6. IL-6 is currently known to be involved in—amongst others—the regulation of the immune response, hematopoiesis, the acute phase response, bone metabolism, angiogenesis, and inflammation.

Interleukin-6 (IL6) is a pleiotropic cytokine involved in many physiological processes including regulation of inflammation, immune responses and hematopoiesis. IL6 exerts its biological activities through 2 membrane molecules, a ligand binding 80 kDa chain (IL6-R) and a non-ligand-binding signal transducer gp130. Formation of the IL6-IL6-R-gp130 signaling complex occurs sequentially: first IL6 binds to IL6-R (Kd: ~10 nM). Next step is binding of this complex to gp130 via interaction sites II and III (Kd: 0.8 nM). Interaction sites II and III are composite sites comprising residues of both IL6 and 116-R. IL6 and IL6-R alone have no detectable affinity for gp130. The exact stoichiometry and composition of the IL6-IL6-R-gp130 complex is still under debate. The crystal structure of IL6-IL6-R-complex has been solved (Boulanger, 2003, Science 300: 2101-2104) and suggests a 2:2:2 stoichiometry. Besides the membrane-bound IL6-R, a soluble form (sIL6-R) can be generated by proteolytic cleavage (TACE/ADAM17) or alternative splicing. The complex of IL6 and sIL6-R can also bind to gp130. Interestingly, this also happens in cells which do not express endogenous IL-6R. Consequently, cells which release the sIL6-R protein render cells which only express gp130 responsive towards the cytokine IL6. This mechanism has been termed trans-signaling.

Deregulation of IL-6 production is implicated in the pathology of several autoimmune and chronic inflammatory proliferative disease processes (Ishihara and Hirano, 2002, Biochim. Biophys. Acta, 1592: 281-96). As a consequence, inhibitors of IL-6 induced signaling have attracted much attention in the past (Hirano et al., 1990, Immunol. Today, 11: 443-9). Polypeptides specifically binding to IL-6 (Klein et al., 1991, Blood, 78: 1198-204; EP 0312996), IL-6R (EP 0409607) or gp130 (Saito et al., 1993, J. Immunol. Methods, 163: 217-223; EP 0572118) proved to exhibit an efficient inhibitory effect on IL-6 functioning.

IL-6 overproduction and signalling (and in particular so-called trans-signalling) are involved in various diseases and disorders, such as sepsis (Starnes et al., 1999, J. Immunol., 148: 1968) and various forms of cancer such as multiple myeloma disease (MM), renal cell carcinoma (RCC), plasma cell leukaemia (Klein et al., 1991), lymphoma, B-lymphoproliferative disorder (BLPD) and prostate cancer. Non-limiting examples of other diseases caused by excessive IL-6 production or signalling include bone resorption (osteoporosis) (Roodman et al., 1992, J. Bone Miner. Res., 7: 475-8; Jilka et al., 1992, Science, 257: 88-91), cachexia (Strassman et al., 1992, J. Clin. Invest. 89: 1681-1684), psoriasis, mesangial proliferative glomerulonephritis, Kaposi's sarcoma, AIDS-related lymphoma (Emilie et al., 1994, Int. J. Immunopharmacol. 16: 391-6), inflammatory diseases and disorder such as rheumatoid arthritis, systemic onset juvenile idiopathic arthritis, hypergammaglobulinemia (Grau et al., 1990, J. Exp. Med. 172: 1505-8); Crohn's disease, ulcerative colitis, systemic lupus erythematosus (SLE), multiple sclerosis, Castleman's disease, IgM gammopathy, cardiac myxoma, asthma (in particular allergic asthma) and autoimmune insulin-dependent diabetes mellitus (Campbell et al., 1991, J. Clin. Invest. 87: 739-742). Other IL-6 related disorders will be clear to the skilled person.

As can for example be seen from the references above, the prior art describes antibodies and antibody fragments directed against human IL-6, against human IL-6R and against human gp130 protein for the prevention and treatment of IL-6 relates disorders. Examples are Tocilizumab (see Woo P, et al., 2005, Arthritis Res. Ther. 7: 1281-8; Nishimoto N et al., 2005, Blood 106: 2627-32; Ito H et al., 2004, Gastroenterology 126: 989-96; Choy E H et al., 2002, Arthritis Rheum. 46: 3143-50), BE8 (see Bataille R et al., 1995, Blood 86: 685-91; Emilie D et al., 1994, Blood 84: 2472-9; Beck J T et al., 1994, N. Engl. J. Med. 330: 602-5; Wendling D et al., 1993, J. Rheumatol. 20: 259-62), CNTO-328 of Centocor (see 2004, Journal of Clinical Oncology, 22/145: 2560; 2004, Journal of Clinical Oncology, 22/145: 2608; 2004, Int. J. Cancer 111: 592-5), C326 (anti-IL6 avirner, Avidia) and M182 (Gaillard et al., 1996, Immunology 89: 135-141). Another active principle known in the art for the prevention and treatment of IL-6 related disorders is an Fc fusion of soluble gp130 (see Becker C et al., 2004, Immunity 21: 491-501; Doganci A et al., 2005, J. Clin. Invest. 115: 313-25; Nowell M A et al., 2003, J. Immunol. 171: 3202-9; Atreya R et al., 2000, Nat, Med. 6: 583-8).

CNTO-328 and Tocilizumab are currently in clinical trials for MM, RCC, RA, soJIA, CD and SLE. Tocilizumab is available on the Japanese market since 2005 for treatment of Castleman's disease (Actemra).

SUMMARY OF THE INVENTION

A specific, but non-limiting object of the present invention is to provide amino acid sequences, polypeptides and therapeutic compounds and compositions that have improved therapeutic and/or pharmacological properties, in addition to other advantageous properties (such as, for example, improved ease of preparation and/or reduced costs of goods), compared to the prior art amino acid sequences, antibodies and Nanobodies. These improved and advantageous properties will become clear from the further description herein. Without being limiting, the amino acid sequences, polypeptides and therapeutic compounds and compositions provided by the invention may have an improved binding and/or affinity, improved avidity, improved efficacy and/or potency, an increased selectivity and/or they may be capable of partially or preferably totally blocking the interaction of IL-6 with IL-6R and/or the interaction of gp130 with the IL-6/IL-6R complex, and/or inhibit signalization through IL-6, IL-6R, the IL-6/IL-6R complex, and/or gp130.

Generally, it is an object of the invention to provide pharmacologically active agents, as well as compositions comprising the same, that can be used in the diagnosis, prevention and/or treatment of one or more IL-6R related disorders (as defined herein); and to provide methods for the diagnosis, prevention and/or treatment of such diseases and disorders that involve the administration and/or use of such agents and compositions.

The invention provides amino acid sequences, Nanobodies and polypeptides that are directed against (as defined herein) and/or can specifically bind (as defined herein) to IL-6R; as well as compounds and constructs, and in particular proteins and polypeptides, that comprise at least one such amino acid sequence.

In a specific aspect, the present invention provides amino acid sequences and polypeptides (also referred to as "polypeptides of the invention") that are capable of binding to two or more different antigenic determinants, epitopes, parts, domains of IL-6R. In this context, the amino acid sequences and polypeptides of the invention are also referred to as "multiparatopic" (such as e.g. "biparatopic" or "triparatopic", etc.) amino acid sequences and polypeptides. The multiparatopic amino acid sequences and polypeptides of the invention can be directed against any antigenic determinants, epitopes, parts, and/or domains of IL-6R. The present inventors surprisingly observed that polypeptides that contained two or more amino acid sequences directed against IL-6R showed much improved properties [such as improved binding (higher avidity to IL-6R) and improved efficacy] which were many times (5 to 10 times in plasma potency assay; 40 to 100 times in TF-1 assay) higher than what would be estimated based on the duplication of said properties of the corresponding monomeric/monovalent amino acid sequence(s).

For example, and generally, a biparatopic polypeptide of the invention may comprise at least one amino acid sequence and/or Nanobody directed against a first antigenic determinant, epitope, part or domain of IL-6R and at least one amino acid sequence and/or Nanobody directed against a second antigenic determinant, epitope, part or domain of IL-6R different from the first antigenic determinant, epitope, part or domain (in which said amino acid sequences and/or Nanobody may be suitably linked, for example via a suitable linker as further described herein). Preferably, such a biparatopic polypeptide of the invention is further such that, when it binds to IL-6R, it is capable of simultaneously binding to the first antigenic determinant, epitope, part or domain (i.e. via the at least one amino acid sequence and/or Nanobody of the invention capable of binding to said first antigenic determinant, epitope, part or domain) and binding to said second antigenic determinant, epitope, part or domain (i.e. via the at least one amino acid sequence and/or Nanobody of the invention capable of binding to said second antigenic determinant, epitope, part or domain). Examples of such biparatopic polypeptides of the invention will become clear from the further description herein. Also, a triparatopic polypeptide of the invention may comprise at least one further amino acid sequence and/or Nanobody of the invention directed against a third antigenic determinant, epitope, part or domain of IL-6R (different from both the first and second antigenic determinant, epitope, part or domain), and generally multiparatopic polypeptides of the invention may contain at least two amino acid sequences and/or Nanobodies of the invention directed against at least two different antigenic determinants, epitopes, parts or domains of IL-6R. Generally, such biparatopic, triparatopic and multiparatopic polypeptides of the invention may be as further described herein, and the various preferred aspects of the invention as described herein also apply to these biparatopic, triparatopic and multiparatopic polypeptides of the invention (for example, these biparatopic, triparatopic and multiparatopic polypeptides of the invention preferably comprise single variable domains and more preferably Nanobodies).

Preferably, the epitopes bound by the amino acid sequences and/or Nanobodies comprised in the biparatopic (or multiparatopic) polypeptides of the invention are extracellular epitopes. Some specific epitopes to which the amino acid sequences and/or Nanobodies and polypeptides of the invention may preferably bind will become clear from the further description herein.

Such biparatopic (or multiparatopic) polypeptides of the invention are preferably at least capable, upon binding to IL-6R, (i) to modulate, and in particular inhibit and/or prevent, binding of IL-6R to IL-6 and/or binding of the IL-6/IL-6R complex to gp130 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways.

Such biparatopic (or multiparatopic) polypeptides of the invention preferably comprise at least one amino acid sequence and/or Nanobody that is capable, upon binding to IL-6R, (i) to modulate, and in particular inhibit and/or prevent, binding of IL-6R to IL-6 and/or binding of the IL-6/IL-6R complex to gp130 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways; as well as at least one further amino acid sequence and/or Nanobody that is capable of binding to at least one other antigenic determinant, epitope, part or domain on IL-6R (i.e. different from the antigenic determinant, epitope, part or domain to which the aforementioned amino acid sequence and/or Nanobody can bind).

For example, without being limiting, the biparatopic (or multiparatopic) polypeptides of the invention may be directed against an epitope that lies in, forms part of, or overlaps with (i.e. in the primary or tertiary structure) or is in close proximity to (i.e. in the primary or tertiary structure) the IL-6 binding site on IL-6R (for example, competitively with IL-6) and/or are capable of competing with ft-6 for binding to IL-6R, as well as against at least one other antigenic determinant, epitope, part or domain on IL-6R. Generally, such a biparatopic (or multiparatopic) polypeptides of the invention will contain at least one amino acid sequence and/or Nanobody that is capable of binding an epitope that lies in, forms part of, or overlaps with (i.e. in the primary or tertiary structure) or is in dose proximity to (i.e. in the primary or tertiary structure) the IL-6 binding site on IL-6R (for example, competitively with IL-6), and/or that is capable of competing with IL-6 for binding to IL-6R, as well as at least one further amino acid sequence and/or Nanobody that is capable of binding to at least one other antigenic determinant, epitope, part or domain on IL-6R.

In a preferred, but non-limiting aspect, the biparatopic (or multiparatopic) polypeptides of the invention are directed against one or more of the 18 contact residues as described in Boulanger et al. (2003, Science 300: 2101-2104) present in the extracellular D3 domain of the IL-6R, more preferably amino acid residues Phe229 and Phe279 present in the extracellular D3 domain of the IL-6R).

In another preferred, but non-limiting aspect, the biparatopic (or multiparatopic) polypeptides of the invention are directed against an epitope that lies in, forms part of, or overlaps with (i.e. in the primary or tertiary structure) or is in close proximity to (i.e. in the primary or tertiary structure) the gp130 binding site on IL-6R and/or the IL-6/IL-6R complex (for example, competitively with gp130); and/or are capable of competing with gp130 for binding to the IL-6/IL-6R complex, as well as against at least one other antigenic determinant, epitope, part or domain on IL-6R. Generally, such a biparatopic (or multiparatopic) polypeptides of the invention will contain at least one amino acid sequence and/or Nanobody that is capable of binding an epitope that lies in, forms part of, or overlaps with (i.e. in the primary or tertiary structure) or is in close proximity to (i.e. in the primary or tertiary structure) the gp130 binding site on IL-6R and/or the IL-6/IL-6R complex (for example, competitively with gp130), and/or that is capable of competing with gp130 for binding to the IL-6/IL-6R complex, as well as at least one further amino acid sequence and/or Nanobody that is capable of binding to at least one other antigenic determinant, epitope, part or domain on IL-6R.

In a preferred, but non-limiting aspect, the biparatopic (or multiparatopic) polypeptides of the invention are directed against an epitope that lies in, forms part of, or overlaps with (i.e. in the primary or tertiary structure) or is in close proximity to (i.e. in the primary or tertiary structure) the BN-12 binding site on IL-6R (for example, competitively with BN-12) and/or are capable of competing with BN-12 for binding to IL-6R, as well as against at least one other antigenic determinant, epitope, part or domain on IL-6R. Generally, such a biparatopic (or multiparatopic) polypeptides of the invention will contain at least one amino acid sequence and/or Nanobody that is capable of binding an epitope that lies in, forms part of, or overlaps with (i.e. in the primary or tertiary structure) or is in close proximity to (i.e. in the primary or tertiary structure) the BN-12 binding site on IL-6R (for example, competitively with BN-12), and/or that is capable of competing with BN-12 for binding to IL-6R, as well as at least one further amino acid sequence and/or Nanobody that is capable of binding to at least one other antigenic determinant, epitope, part or domain on IL-6R.

The at least one further amino acid sequence and/or Nanobody that is capable of binding to at least one other antigenic determinant, epitope, part or domain on IL-6R may be any amino acid sequence and/or Nanobody that is directed against and/or capable of binding IL-6R.

In a preferred but non-limiting aspect, the at least one further amino acid sequence and/or Nanobody that is capable of binding to at least one other antigenic determinant, epitope, part or domain on IL-6R binds an epitope present in the extracellular D1 domain; and/or said at least one further amino acid sequence and/or Nanobody will recognize and/or specifically bind IL-6R while not binding the hybrid IL-6R (as described in Example 3; SEQ ID NO: 131). Accordingly, in a preferred but non-limiting aspect, the biparatopic (or multiparatopic) polypeptides of the invention may also be directed against an epitope that lies in, forms part of, or overlaps with (i.e. in the primary or tertiary structure) or is in close proximity to (i.e. in the primary or tertiary structure) the D1 domain of IL-6R and/or may be capable of specifically binding IL-6R while not binding the hybrid IL-6R (as described in Example 3; SEQ ID NO: 131).

In another preferred but non-limiting aspect, the at least one further amino acid sequence and/or Nanobody that is capable of binding to at least one other antigenic determinant, epitope, part or domain on IL-6R binds an epitope present in the extracellular D2 domain; and/or said at least one further amino acid sequence and/or Nanobody will recognize and/or specifically bind IL-6R as well as the hybrid IL-6R (as described in Example 3; SEQ ID NO: 131). Accordingly, in a preferred but non-limiting aspect, the biparatopic (or multiparatopic) polypeptides of the invention may also be directed against an epitope that lies in, forms part of, or overlaps with (i.e. in the primary or tertiary structure) or is in close proximity to (i.e. in the primary or tertiary structure) the D2 domain of IL-6R and/or may be capable of specifically binding IL-6R as well as the hybrid IL-6R (as described in Example 3; SEQ ID NO: 131).

In another preferred but non-limiting aspect, the at least one further amino acid sequence and/or Nanobody that is capable of binding to at least one other antigenic determinant, epitope, part or domain on IL-6R binds an epitope present in the extracellular D3 domain; and/or said at least one further amino acid sequence and/or Nanobody will recognize and/or specifically bind IL-6R as well as the hybrid IL-6R (as described in Example 3; SEQ ID NO: 131). Accordingly, in a preferred but non-limiting aspect, the biparatopic (or multiparatopic) polypeptides of the invention may also be directed against an epitope that lies in, forms part of, or overlaps with (i.e. in the primary or tertiary structure) or is in close proximity to (i.e. in the primary or tertiary structure) the D3 domain of IL-6R and/or may be capable of specifically binding IL-6R as well as the hybrid IL-6R (as described in Example 3; SEQ ID NO: 131).

The at least one further amino acid sequence and/or Nanobody that is capable of binding to at least one other antigenic determinant, epitope, part or domain on IL-6R may bind an epitope that lies in, forms part of, or overlaps with (i.e. in the primary or tertiary structure) or is in close proximity to (i.e. in the primary or tertiary structure) the IL-6 binding site on IL-6R (for example, competitively with IL-6) and/or may be capable of competing with IL-6 for binding to IL-6R; the at least one further amino acid sequence and/or Nanobody that is capable of binding to at least one other antigenic determinant, epitope, part or domain on IL-6R may bind one or more of the 18 contact residues as described in Boulanger et al. 2003 (Science 300: 2101-2104) present in the extracellular D3 domain of the IL-6R, more preferably amino acid residues Phe229 and Phe279 present in the extracellular D3 domain of the IL-6R; the at least one further amino acid sequence and/or Nanobody that is capable of binding to at least one other antigenic determinant, epitope, part or domain on IL-6R may bind an epitope that lies in, forms part of, or overlaps with (i.e. in the primary or tertiary structure) or is in close proximity to (i.e. in the primary or tertiary structure) the binding site of the reference IgG and/or the reference Fab on IL-6R (for example, competitively with the reference IgG and/or the reference Fab) and/or may be capable of competing with the reference IgG and/or the reference Fab for binding to IL-6R; and/or the at least one further amino acid sequence and/or Nanobody that is capable of binding to at least one other antigenic determinant, epitope, part or domain on IL-6R may bind an epitope that lies in, forms part of, or overlaps with (i.e. in the primary or tertiary structure) or is in close proximity to (i.e. in the primary or tertiary structure) the Tocilizumab (MRA) binding site on IL-6R (for example, competitively with Tocilizumab (MRA)) and/or my be capable of competing with Tocilizumab (MRA) for binding to IL-6R.

In another aspect, the at least one further amino acid sequence and/or Nanobody that is capable of binding to at least one other antigenic determinant, epitope, part or domain on IL-6R may bind an epitope that lies in, forms part of, or overlaps with (i.e. in the primary or tertiary structure) or is in close proximity to (i.e. in the primary or tertiary structure) the gp130 binding site on IL-6R and/or the IL-6/IL-6R complex (for example, competitively with gp130) and/or may be capable of competing with gp130 for binding to the IL-6/IL-6R complex; and/or the at least one further amino acid sequence and/or Nanobody that is capable of binding to at least one other antigenic determinant, epitope, part or domain on IL-6R may bind an epitope that lies in, forms part of, or overlaps with (i.e. in the primary or tertiary structure) or is in close proximity to (i.e. in the primary or tertiary structure) the M182 binding site on IL-6R (for example, competitively with M182) and/or may be capable of competing with M182 for binding to IL-6R.

In another aspect, the at least one further amino acid sequence and/or Nanobody that is capable of binding to at least one other antigenic determinant, epitope, part or domain on IL-6R may bind an epitope that lies in, forms part of, or overlaps with (i.e. in the primary or tertiary structure) or is in close proximity to (i.e. in the primary or tertiary structure) the BN-12 binding site on IL-6R (for example, competitively with BN-12) and/or may be capable of competing with BN-12 for binding to IL-6R.

As such, the biparatopic (or multiparatopic) polypeptides of the invention may at least be capable, upon binding to IL-6R,
(i) to inhibit or affect (e.g. fully or partially disrupt) the formation of the IL-6/IL-6R complex in such a way that the binding of IL-6 to—e.g. its affinity for—IL-6R is reduced (or reversely, that the binding of IL-6R to—e.g. its affinity for—IL-6 is reduced), so that the signalling, pathway(s) and/or mechanism(s) induced/mediated by the binding of IL-6 to IL-6R is modulated (e.g. reduced) compared to the signalling, pathway(s) and/or mechanism(s) induced/mediated by the binding of IL-6 to IL-6R without the presence of the amino acid sequence and/or polypeptide of the invention; and
(ii) to inhibit or affect (e.g. fully or partially disrupt) the formation of the IL-6/IL-6R complex is in such a way that the binding of the complex to—e.g. its affinity for—gp130 is reduced (or reversely, that the binding of gp 130 to—e.g. its affinity for—the complex is reduced), so that the signalling, pathway(s) and/or mechanism(s) induced/mediated by the binding of the complex to gp130 is modulated (e.g. reduced) compared to the signalling, pathway(s) and/or mechanism(s) induced/mediated by the binding of the complex to gp130 without the presence of the amino acid sequence or Nanobody of the invention.

The biparatopic (or multiparatopic) polypeptides of the invention may at least be capable, upon binding to IL-6R,
(i) to inhibit or affected (e.g. fully or partially disrupt) the formation of the IL-6/IL-6R complex in such a way that the binding of IL-6 to—e.g. its affinity for—IL-6R is reduced (or reversely, that the binding of IL-6R to—e.g. its affinity for—IL-6 is reduced), so that the signalling, pathway(s) and/or mechanism(s) induced/mediated by the binding of IL-6 to IL-6R is modulated (e.g. reduced) compared to the signalling, pathway(s) and/or mechanism(s) induced/mediated by the binding of IL-6 to IL-6R without the presence of the amino acid sequence and/or polypeptide of the invention; and
(ii) to modulate (e.g. inhibit) the binding of the IL-6/IL-6R complex to gp130, so that the signalling, pathway(s) and/or mechanism(s) induced/mediated by the binding of the IL-6/IL-6R complex to gp130 is modulated (e.g. reduced) compared to the signalling, pathway(s) and/or mechanism(s) induced/mediated by the binding of the IL-6/IL-6R complex to gp130 without the presence of the amino acid sequence and/or polypeptide of the invention.

The biparatopic (or multiparatopic) polypeptides of the invention may at least be capable, upon binding to IL-6R,
(i) to inhibit or affect (e.g. fully or partially disrupt) the formation of the IL-6/IL-6R complex is in such a way that the binding of the complex to—e.g. its affinity for—gp130 is reduced (or reversely, that the binding of gp 130 to—e.g. its affinity for—the complex is reduced), so that the signalling, pathway(s) and/or mechanism(s) induced/mediated by the binding of the complex to gp130 is modulated (e.g. reduced) compared to the signalling, pathway(s) and/or mechanism(s) induced/mediated by the binding of the complex to gp130 without the presence of the amino acid sequence or Nanobody of the invention; and
(ii) to modulate (e.g. inhibit) the binding of the IL-6/IL-6R complex to gp130, so that the signalling, pathway(s) and/or mechanism(s) induced/mediated by the binding of the IL-6/IL-6R complex to gp130 is modulated (e.g. reduced) compared to the signalling, pathway(s) and/or mechanism(s) induced/mediated by the binding of the IL-6/IL-6R complex to gp130 without the presence of the amino acid sequence and/or polypeptide of the invention.

The biparatopic (or multiparatopic) polypeptides of the invention may at least be capable, upon binding to IL-6R,
(i) to inhibit or affected (e.g. fully or partially disrupt) the formation of the IL-6/IL-6R complex in such a way that the binding of IL-6 to—e.g. its affinity for—IL-6R is reduced (or reversely, that the binding of IL-6R to—e.g. its affinity for—IL-6 is reduced), so that the signalling, pathway(s) and/or mechanism(s) induced/mediated by the binding of IL-6 to IL-6R is modulated (e.g. reduced) compared to the signalling, pathway(s) and/or mechanism(s) induced/mediated by the binding of IL-6 to IL-6R without the presence of the amino acid sequence and/or polypeptide of the invention;

(ii) to inhibit or affect (e.g. fully or partially disrupt) the formation of the IL-6/IL-6R complex is in such a way that the binding of the complex to—e.g. its affinity for—gp130 is reduced (or reversely, that the binding of gp 130 to—e.g. its affinity for—the complex is reduced), so that the signalling, pathway(s) and/or mechanism(s) induced/mediated by the binding of the complex to gp130 is modulated (e.g. reduced) compared to the signalling, pathway(s) and/or mechanism(s) induced/mediated by the binding of the complex to gp130 without the presence of the amino acid sequence or Nanobody of the invention; and (iii) to modulate (e.g. inhibit) the binding of the IL-6/IL-6R complex to gp130, so that the signalling, pathway(s) and/or mechanism(s) induced/mediated by the binding of the IL-6/IL-6R complex to gp130 is modulated (e.g. reduced) compared to the signalling, pathway(s) and/or mechanism(s) induced/mediated by the binding of the IL-6/IL-6R complex to gp130 without the presence of the amino acid sequence and/or polypeptide of the invention.

The biparatopic (or multiparatopic) polypeptide of the invention or the composition comprising the same should at least "modulate" or effect a change (i.e. an activity, preferably as an antagonist) with respect to at least one the pathway(s) or mechanism(s) in which IL-6, IL-6R, the IL-6/IL-6R complex and/or gp130 (or its pathway(s)) are involved (such as its signalling pathway or metabolic pathway and their associated biological or physiological effects). In one aspect, the biparatopic (or multiparatopic) polypeptide of the invention or the composition comprising the same may "modulate" or effect a change with respect to more than one (such as two, three, four or even more) biological or physiological pathways or mechanisms (i.e. the biparatopic (or multiparatopic) polypeptide of the invention or the composition comprising the same may have more than one mode of action). The different modes of action may be mediated each by one of the binding units (as further defined herein) of the biparatopic (or multiparatopic) polypeptide of the invention, wherein each binding unit binds at a different binding site of IL-6R.

In a preferred aspect, the biparatopic (or multiparatopic) polypeptide of the invention may modulate the signalling, pathway(s) and/or mechanism(s) induced/mediated by the binding of IL-6 to IL-6R and at the same time modulate the signalling, pathway(s) and/or mechanism(s) induced/mediated by the binding of the IL-6/IL-6R complex to gp130. In another preferred aspect, the biparatopic polypeptide of the invention may combine the modes of action of Tocilizumab (MRA) and M182, and/or the modes of action of the reference IgG and/or reference Fab and M182.

Accordingly, the present invention also relates to a biparatopic (or multiparatopic) polypeptide or a composition comprising the same that combines two different modes of action each mediated by one of the binding units of the biparatopic polypeptide of the invention, wherein each binding unit binds at a different binding site of IL-6R.

The amino acid sequences and/or Nanobodies that form (i.e. are comprised in, are encompassed in, are used to generate and/or make up) the biparatopic (or multiparatopic) polypeptides of the invention can be any amino acid sequence and/or Nanobody that is capable of binding to at least one antigenic determinant, epitope, part or domain on IL-6R as long as the resulting biparatopic (or multiparatopic) polypeptides of the invention exhibits the desired effects such as modulating and/or effecting a change (i.e. an activity, preferably as an antagonist) with respect to at least one the pathway(s) or mechanism(s) in which IL-6, IL-6R, the IL-6/IL-6R complex and/or gp130 (or its pathway(s)) are involved (such as its signalling pathway or metabolic pathway and their associated biological or physiological effects). Accordingly, the biparatopic (or multiparatopic) polypeptides of the invention preferably comprise at least one amino acid sequence and/or Nanobody that is capable of binding to at least one antigenic determinant, epitope, part or domain on IL-6R and, in addition, that is inducing to the biparatopic (or multiparatopic) polypeptide of the invention the capacity to exhibit the desired effects (as described herein). Preferred amino acid sequences and/or Nanobodies are e.g. described in WO 08/020,079 and/or are described herein (referred to herein as "amino acid sequence of the invention" and "Nanobody of the invention").

In a specific aspect, the amino acid sequences and/or Nanobodies that form (i.e. are comprised in, are encompassed in, are used to generate and/or make up) the biparatopic (or multiparatopic) polypeptides of the invention may bind to IL-6R with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein.

In particular, the amino acid sequences and/or Nanobodies that form (i.e. are comprised in, are encompassed in, are used to generate and/or make up) the biparatopic (or multiparatopic) polypeptides of the invention are preferably such that they:

bind to IL-6R with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles);

and/or such that they:

bind to IL-6R with a $k_{on}$-rate of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$;

and/or such that they:

bind to IL-6R with a $k_{off}$ rate between 1 $s^{-1}$ ($t_{1/2}$=0.69 s) and $10^{-6}$ $s^{-1}$ (providing a near irreversible complex with a $t_{1/2}$ of multiple days), preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Preferably, a monovalent amino acid sequence of the invention (or a polypeptide that contains only one amino acid sequence of the invention) is preferably such that it will bind to IL-6R with an affinity less than 500 nM, preferably less than 200 nM, more preferably less than 10 nM, such as less than 500 µM.

Some preferred IC50 values for binding of the amino acid sequences, Nanobodies and/or polypeptides of the invention to IL-6R will become clear from the further description and examples herein.

In its broadest sense, the amino acid sequences and/or Nanobodies that form (i.e. are comprised in, are encompassed in, are used to generate and/or make up) the biparatopic (or multiparatopic) polypeptides of the invention are not particularly limited to binding or defined by a specific antigenic determinant, epitope, part or domain of IL-6R against which they are directed. In one aspect of the invention, these amino acid sequences and/or Nanobodies are preferably directed against any epitope of the IL-6 receptor involved in the interaction of the IL-6 receptor with IL-6.

Such epitopes or interaction sites have been described in detail in Boulanger et al. (2003, Science 300: 2101-2104) and reference is specifically made to FIG. 2 in cited reference. More preferably, these amino acid sequences and/or Nanobodies may be directed against an extracellular domain of the IL-6 receptor, such as the D1 domain, the D2 domain and/or the D3 domain. Still more preferably, these amino acid sequences and/or Nanobodies may be directed against the extracellular D3 domain of the IL-6 receptor. Still more preferably, these amino acid sequences and/or Nanobodies may interact with one or more of the 18 contact residues as described in Boulanger et al. (2003, Science 300: 2101-2104) present in the extracellular D3 domain of the IL-6 receptor that contribute to the interaction of the IL-6 receptor with IL-6. Most preferably, these amino acid sequences and/or Nanobodies interact with amino acid residues Phe229 and Phe279 present in the extracellular D3 domain of the IL-6 receptor.

Thus, in one preferred, but non-limiting aspect, the amino acid sequences and/or Nanobodies that form (i.e. are comprised in, are encompassed in, are used to generate and/or make up) the biparatopic (or multiparatopic) polypeptides of the invention are directed against an epitope of the IL-6 receptor involved in the interaction of the IL-6 receptor with IL-6, and are as further defined herein.

Alternatively the amino acid sequences and/or Nanobodies that form (i.e. are comprised in, are encompassed in, are used to generate and/or make up) the biparatopic (or multiparatopic) polypeptides of the invention are directed against any epitope of the IL-6 receptor involved in the interaction of the IL-6 receptor and/or the IL-6/IL-6R complex with gp130. Such epitopes or interaction sites have been described in detail in Boulanger et al. (2003, Science 300: 2101-2104) and reference is specifically made to FIG. 2 in cited reference.

In this context, according to a non-limiting aspect, these amino acid sequences and/or Nanobodies are preferably such that they can compete for binding to the IL-6 receptor with the commercially available human-mouse reconstituted chimeric monoclonal anti-IL6R antibody Tocilizumab (MRA) (Chugai/Roche) or an antigen binding fragment thereof (see for example WO 92/19759 and corresponding European patent EP 0628639, as well as Shinkura et al., 1998, Anticancer Research 18: 1217-1222), for example in the assay described in Example 11; and/or such that they can bind to the same epitope or binding site on IL-6R as Tocilizumab (MRA), or to an epitope close to said binding site and/or overlapping with said binding site.

Also, according to a non-limiting aspect, these amino acid sequences and/or Nanobodies are preferably such that they can compete for binding to the IL-6 receptor with the reference IgG and/or reference Fab according to EP 0628639; and/or such that they can bind to the same epitope or binding site on IL-6R as said reference IgG or reference Fab, or to an epitope close to said binding site and/or overlapping with said binding site. For the preparation and sequence of said reference IgG and reference Fab, reference is made to Example 1 below, as well as to SEQ ID NO's: 126 to 129.

Thus, generally and without limitation, the amino acid sequences and/or Nanobodies that form (i.e. are comprised in, are encompassed in, are used to generate and/or make up) the biparatopic (or multiparatopic) polypeptides of the invention may be directed against any epitope of the IL-6 receptor involved in the interaction of the IL-6 receptor with IL-6 and/or the interaction of IL-6R and/or the IL-6/IL-6R complex with gp130.

In one specific, but non-limiting aspect, the amino acid sequence that forms (i.e. is comprised in, is encompassed in, is used to generate and/or make up) the biparatopic (or multiparatopic) polypeptides of the invention may be an amino acid sequence that comprises an immunoglobulin fold or may be an amino acid sequence that, under suitable conditions (such as physiological conditions) is capable of forming an immunoglobulin fold (i.e. by folding). Reference is inter alia made to the review by Halaby et al. (1999, J. Protein Eng. 12: 563-71). Preferably, when properly folded so as to form an immunoglobulin fold, such an amino acid sequence is capable of specific binding (as defined herein) to IL-6R; and more preferably capable of binding to IL-6R with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein. Also, parts, fragments, analogs, mutants, variants, alleles and/or derivatives of such amino acid sequences are preferably such that they comprise an immunoglobulin fold or are capable for forming, under suitable conditions, an immunoglobulin fold.

In particular, but without limitation, the amino acid sequence may be amino acid sequence that essentially consists of 4 framework regions (FR1 to FR4 respectively) and 3 complementarity determining regions (CDR1 to CDR3 respectively); or any suitable fragment of such an amino acid sequence (which will then usually contain at least some of the amino acid residues that form at least one of the CDR's, as further described herein).

The amino acid sequence may in particular be an immunoglobulin sequence or a suitable fragment thereof, and more in particular be an immunoglobulin variable domain sequence or a suitable fragment thereof, such as light chain variable domain sequence (e.g. a $V_L$-sequence) or a suitable fragment thereof; or a heavy chain variable domain sequence (e.g. a $V_H$-sequence) or a suitable fragment thereof. When the amino acid sequence is a heavy chain variable domain sequence, it may be a heavy chain variable domain sequence that is derived from a conventional four-chain antibody (such as, without limitation, a $V_H$ sequence that is derived from a human antibody) or be a so-called $V_{HH}$-sequence (as defined herein) that is derived from a so-called "heavy chain antibody" (as defined herein).

The amino acid sequence that forms (i.e. is comprised in, is encompassed in, is used to generate and/or make up) the biparatopic (or multiparatopic) polypeptides of the invention may in particular be a domain antibody (or an amino acid sequence that is suitable for use as a domain antibody), a single domain antibody (or an amino acid sequence that is suitable for use as a single domain antibody), a "dAb" (or an amino acid sequence that is suitable for use as a dAb) or a Nanobody™ (as defined herein, and including but not limited to a $V_{HH}$ sequence); other single variable domains, or any suitable fragment of any one thereof. For a general description of (single) domain antibodies, reference is also made to the prior art cited above, as well as to EP 0368684. For the term "dAb's", reference is for example made to Ward et al. (1989, Nature 341 (6242): 544-6), to Holt et al. (2003, Trends Biotechnol., 21(11): 484-490); as well as to for example WO 06/030220, WO 06/003388 and other published patent applications of Domantis Ltd. It should also be noted that, although less preferred in the context of the present invention because they are not of mammalian origin, single domain antibodies or single variable domains can be derived from certain species of shark (for example, the so-called "IgNAR domains", see for example WO 05/18629).

In particular, the amino acid sequence of the invention may be a Nanobody® (as defined herein) or a suitable fragment thereof. [Note: Nanobody®, Nanobodies® and Nanoclone® are registered trademarks of Ablynx N.V.]

In a non-limiting aspect of the invention, the amino acid sequences and/or Nanobodies that form (i.e. are comprised in, are encompassed in, are used to generate and/or make up) the biparatopic (or multiparatopic) polypeptides of the invention, comprise CDR sequences that are generally as further defined herein (these amino acid sequences and/or Nanobodies are also encompassed in the present invention and are also referred to as "amino acid sequences of the invention" and "Nanobodies of the invention").

Thus, the invention also relates to such amino acid sequences and/or Nanobodies that can bind to (as defined herein) and/or are directed against IL-6R and that comprise CDR sequences that are generally as further defined herein, to suitable fragments thereof, as well as to polypeptides that comprise or essentially consist of one or more of such Nanobodies and/or suitable fragments. In a preferred aspect, the invention relates to Nanobodies with SEQ ID NO's: 132 to 216 (see Tables A-1 and A-3).

In particular, the invention in some specific aspects provides:
amino acid sequences that are directed against (as defined herein) IL-6R and that have at least 80%, preferably at least 85%, such as 90% or 95% or more sequence identity with at least one of the amino acid sequences of SEQ ID NO's: 132-216 (see Table A-3);
amino acid sequences that cross-block (as defined herein) the binding of at least one of the amino acid sequences of SEQ ID NO's: 132-216 (see Table A-3) to IL-6R and/or that compete with at least one of the amino acid sequences of SEQ ID NO's: 132-216 (see Table A-3) for binding to IL-6R;
which amino acid sequences may be as further described herein (and may for example be Nanobodies); as well as polypeptides of the invention that comprise one or more of such amino acid sequences (which may be as further described herein), and particularly biparatopic (or multiparatopic) polypeptides as described herein, and nucleic acid sequences that encode such amino acid sequences and polypeptides. Such amino acid sequences and polypeptides do not include any naturally occurring ligands.

For binding to IL-6R, an amino acid sequence or Nanobody of the invention will usually contain within its amino acid sequence one or more amino acid residues or one or more stretches of amino acid residues (i.e. with each "stretch" comprising two or amino acid residues that are adjacent to each other or in close proximity to each other, i.e. in the primary or tertiary structure of the amino acid sequence) via which the amino acid sequence or Nanobody of the invention can bind to IL-6R, which amino acid residues or stretches of amino acid residues thus form the "site" for binding to IL-6R (also referred to herein as the "antigen binding site").

Thus, in one specific, but non-limiting aspect, the invention relates to an amino acid sequence directed against IL-6R, that comprises one or more stretches of amino acid residues chosen from the group consisting of:
a) the amino acid sequences of SEQ ID NO's: 302-386;
b) amino acid sequences that have at least 80% amino acid identity with at least one of the amino acid sequences of SEQ ID NO's: 302-386;
c) amino acid sequences that have 3, 2, or 1 amino acid difference with at least one of the amino acid sequences of SEQ ID NO's: 302-386;
d) the amino acid sequences of SEQ ID NO's: 472-556;
e) amino acid sequences that have at least 80% amino acid identity with at least one of the amino acid sequences of SEQ ID NO's: 472-556;
f) amino acid sequences that have 3, 2, or 1 amino acid difference with at least one of the amino acid sequences of SEQ ID NO's: 472-556;
g) the amino acid sequences of SEQ ID NO's: 642-726;
h) amino acid sequences that have at least 80% amino acid identity with at least one of the amino acid sequences of SEQ ID NO's: 642-726;
i) amino acid sequences that have 3, 2, or 1 amino acid difference with at least one of the amino acid sequences of SEQ ID NO's: 642-726;
or any suitable combination thereof.

In this specific aspect, the amino acid sequence preferably comprises one or more stretches of amino acid residues chosen from the group consisting of:
i) the amino acid sequences of SEQ ID NO's: 302-386;
ii) the amino acid sequences of SEQ ID NO's: 472-556; and
iii) the amino acid sequences of SEQ ID NO's: 642-726;
or any suitable combination thereof.

Also, preferably, in such an amino acid sequence, at least one of said stretches of amino acid residues forms part of the antigen binding site for binding against IL-6R.

In a more specific, but again non-limiting aspect, the invention relates to an amino acid sequence directed against IL-6R, that comprises two or more stretches of amino acid residues chosen from the group consisting of:
a) the amino acid sequences of SEQ ID NO's: 302-386;
b) amino acid sequences that have at least 80% amino acid identity with at least one of the amino acid sequences of SEQ ID NO's: 302-386;
c) amino acid sequences that have 3, 2, or 1 amino acid difference with at least one of the amino acid sequences of SEQ ID NO's: 302-386;
d) the amino acid sequences of SEQ ID NO's: 472-556;
e) amino acid sequences that have at least 80% amino acid identity with at least one of the amino acid sequences of SEQ ID NO's: 472-556;
f) amino acid sequences that have 3, 2, or 1 amino acid difference with at least one of the amino acid sequences of SEQ ID NO's: 472-556;
g) the amino acid sequences of SEQ ID NO's: 642-726;
h) amino acid sequences that have at least 80% amino acid identity with at least one of the amino acid sequences of SEQ ID NO's: 642-726;
i) amino acid sequences that have 3, 2, or 1 amino acid difference with at least one of the amino acid sequences of SEQ ID NO's: 642-726;
such that (i) when the first stretch of amino acid residues corresponds to one of the amino acid sequences according to a), b) or c), the second stretch of amino acid residues corresponds to one of the amino acid sequences according to d), e), f), g), h) or i); (ii) when the first stretch of amino acid residues corresponds to one of the amino acid sequences according to d), e) or f), the second stretch of amino acid residues corresponds to one of the amino acid sequences according to a), b), c), g), h) or i); or (iii) when the first stretch of amino acid residues corresponds to one of the amino acid sequences according to g), h) or i), the second stretch of amino acid residues corresponds to one of the amino acid sequences according to a), b), c), d), e) or f).

In this specific aspect, the amino acid sequence preferably comprises two or more stretches of amino acid residues chosen from the group consisting of:
i) the amino acid sequences of SEQ ID NO's: 302-386;
ii) the amino acid sequences of SEQ ID NO's: 472-556; and
iii) the amino acid sequences of SEQ ID NO's: 642-726;
such that, (i) when the first stretch of amino acid residues corresponds to one of the amino acid sequences of SEQ ID NO's: 302-386, the second stretch of amino acid residues corresponds to one of the amino acid sequences of SEQ ID NO's: 472-556 or of SEQ ID NO's: 642-726; (ii) when the first stretch of amino acid residues corresponds to one of the amino acid sequences of SEQ ID NO's: 472-556, the second stretch of amino acid residues corresponds to one of the amino acid sequences of SEQ ID NO's: 302-386 or of SEQ ID NO's: 642-726; or (iii) when the first stretch of amino acid residues corresponds to one of the amino acid sequences of SEQ ID NO's: 642-726, the second stretch of amino acid residues corresponds to one of the amino acid sequences of SEQ ID NO's: 302-386 or of SEQ ID NO's: 472-556.

Also, in such an amino acid sequence, the at least two stretches of amino acid residues again preferably form part of the antigen binding site for binding against IL-6R.

In an even more specific, but non-limiting aspect, the invention relates to an amino acid sequence directed against IL-6R, that comprises three or more stretches of amino acid residues, in which the first stretch of amino acid residues is chosen from the group consisting of:
a) the amino acid sequences of SEQ ID NO's: 302-386;
b) amino acid sequences that have at least 80% amino acid identity with at least one of the amino acid sequences of SEQ ID NO's: 302-386;
c) amino acid sequences that have 3, 2, or 1 amino acid difference with at least one of the amino acid sequences of SEQ ID NO's: 302-386;
the second stretch of amino acid residues is chosen from the group consisting of:
d) the amino acid sequences of SEQ ID NO's: 472-556;
e) amino acid sequences that have at least 80% amino acid identity with at least one of the amino acid sequences of SEQ ID NO's: 472-556;
f) amino acid sequences that have 3, 2, or 1 amino acid difference with at least one of the amino acid sequences of SEQ ID NO's: 472-556;
and the third stretch of amino acid residues is chosen from the group consisting of:
g) the amino acid sequences of SEQ ID NO's: 642-726;
h) amino acid sequences that have at least 80% amino acid identity with at least one of the amino acid sequences of SEQ ID NO's: 642-726;
i) amino acid sequences that have 3, 2, or 1 amino acid difference with at least one of the amino acid sequences of SEQ ID NO's: 642-726.

Preferably, in this specific aspect, the first stretch of amino acid residues is chosen from the group consisting of the amino acid sequences of SEQ ID NO's: 302-386; the second stretch of amino acid residues is chosen from the group consisting of the amino acid sequences of SEQ ID NO's: 472-556; and the third stretch of amino acid residues is chosen from the group consisting of the amino acid sequences of SEQ ID NO's: 642-726.

Again, preferably, in such an amino acid sequence, the at least three stretches of amino acid residues forms part of the antigen binding site for binding against IL-6R.

Preferred combinations of such stretches of amino acid sequences will become clear from the further disclosure herein.

Preferably, in such amino acid sequences the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 132-216 (see Table A-1). This degree of amino acid identity can for example be determined by determining the degree of amino acid identity (in a manner described herein) between said amino acid sequence and one or more of the sequences of SEQ ID NO's: 132-216 (see Table A-3), in which the amino acid residues that form the framework regions are disregarded. Also, such amino acid sequences of the invention can be as further described herein.

Also, such amino acid sequences are preferably such that they can specifically bind (as defined herein) to IL-6R; and more in particular bind to IL-6R with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein.

When the amino acid sequence of the invention essentially consists of 4 framework regions (FR1 to FR4, respectively) and 3 complementarity determining regions (CDR1 to CDR3, respectively), the amino acid sequence of the invention is preferably such that:
CDR1 is chosen from the group consisting of:
a) the amino acid sequences of SEQ ID NO's: 302-386;
b) amino acid sequences that have at least 80% amino acid identity with at least one of the amino acid sequences of SEQ ID NO's: 302-386;
c) amino acid sequences that have 3, 2, or 1 amino acid difference with at least one of the amino acid sequences of SEQ ID NO's: 302-386;
and/or
CDR2 is chosen from the group consisting of:
d) the amino acid sequences of SEQ ID NO's: 472-556;
e) amino acid sequences that have at least 80% amino acid identity with at least one of the amino acid sequences of SEQ ID NO's: 472-556;
f) amino acid sequences that have 3, 2, or 1 amino acid difference with at least one of the amino acid sequences of SEQ ID NO's: 472-556;
and/or
CDR3 is chosen from the group consisting of:
g) the amino acid sequences of SEQ ID NO's: 642-726;
h) amino acid sequences that have at least 80% amino acid identity with at least one of the amino acid sequences of SEQ ID NO's: 642-726;
i) amino acid sequences that have 3, 2, or 1 amino acid difference with at least one of the amino acid sequences of SEQ ID NO's: 642-726.

In particular, such an amino acid sequence of the invention may be such that CDR1 is chosen from the group consisting of the amino acid sequences of SEQ ID NO's:

302-386; and/or CDR2 is chosen from the group consisting of the amino acid sequences of SEQ ID NO's: 472-556; and/or CDR3 is chosen from the group consisting of the amino acid sequences of SEQ ID NO's: 642-726.

In particular, when the amino acid sequence of the invention essentially consists of 4 framework regions (ER1 to FR4, respectively) and 3 complementarity determining regions (CDR1 to CDR3, respectively), the amino acid sequence of the invention is preferably such that:

CDR1 is chosen from the group consisting of:
a) the amino acid sequences of SEQ ID NO's: 302-386;
b) amino acid sequences that have at least 80% amino acid identity with at least one of the amino acid sequences of SEQ ID NO's: 302-386;
c) amino acid sequences that have 3, 2, or 1 amino acid difference with at least one of the amino acid sequences of SEQ ID NO's: 302-386;
and
CDR2 is chosen from the group consisting of:
d) the amino acid sequences of SEQ ID NO's: 472-556;
e) amino acid sequences that have at least 80% amino acid identity with at least one of the amino acid sequences of SEQ ID NO's: 472-556;
f) amino acid sequences that have 3, 2, or 1 amino acid difference with at least one of the amino acid sequences of SEQ ID NO's: 472-556;
and
CDR3 is chosen from the group consisting of:
g) the amino acid sequences of SEQ ID NO's: 642-726;
h) amino acid sequences that have at least 80% amino acid identity with at least one of the amino acid sequences of SEQ ID NO's: 642-726;
i) amino acid sequences that have 3, 2, or 1 amino acid difference with at least one of the amino acid sequences of SEQ ID NO's: 642-726; or any suitable fragment of such an amino acid sequence In particular, such an amino acid sequence of the invention may be such that CDR1 is chosen from the group consisting of the amino acid sequences of SEQ ID NO's: 302-386; and CDR2 is chosen from the group consisting of the amino acid sequences of SEQ ID NO's: 472-556; and CDR3 is chosen from the group consisting of the amino acid sequences of SEQ ID NO's: 642-726.

Again, preferred combinations of CDR sequences will become clear from the further description herein.

Also, such amino acid sequences are preferably such that they can specifically bind (as defined herein) to IL-6R; and more in particular bind to IL-6R with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein.

In one preferred, but non-limiting aspect, the invention relates to an amino acid sequence that essentially consists of 4 framework regions (FR1 to FR4, respectively) and 3 complementarity determining regions (CDR1 to CDR3, respectively), in which the CDR sequences of said amino acid sequence have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 132-216 (see Table A-1). This degree of amino acid identity can for example be determined by determining the degree of amino acid identity (in a manner described herein) between said amino acid sequence and one or more of the sequences of SEQ ID NO's: 132-216 (see Table A-3), in which the amino acid residues that form the framework regions are disregarded. Such amino acid sequences of the invention can be as further described herein.

In such an amino acid sequence of the invention, the framework sequences may be any suitable framework sequences, and examples of suitable framework sequences will be clear to the skilled person, for example on the basis the standard handbooks and the further disclosure and prior art mentioned herein.

The framework sequences are preferably (a suitable combination of) immunoglobulin framework sequences or framework sequences that have been derived from immunoglobulin framework sequences (for example, by humanization or camelization). For example, the framework sequences may be framework sequences derived from a light chain variable domain (e.g. a $V_L$-sequence) and/or from a heavy chain variable domain (e.g. a $V_H$-sequence). In one particularly preferred aspect, the framework sequences are either framework sequences that have been derived from a $V_{HH}$-sequence (in which said framework sequences may optionally have been partially or fully humanized) or are conventional $V_H$ sequences that have been camelized (as defined herein).

The framework sequences are preferably such that the amino acid sequence of the invention is a domain antibody (or an amino acid sequence that is suitable for use as a domain antibody); is a single domain antibody (or an amino acid sequence that is suitable for use as a single domain antibody); is a "dAb" (or an amino acid sequence that is suitable for use as a dAb); or is a Nanobody (including but not limited to $V_{HH}$ sequence). Again, suitable framework sequences will be clear to the skilled person, for example on the basis the standard handbooks and the further disclosure and prior art mentioned herein.

In particular, the framework sequences present in the amino acid sequences of the invention may contain one or more of Hallmark residues (as defined herein), such that the amino acid sequence of the invention is a Nanobody (also referred to as "Nanobody of the invention"). Some preferred, but non-limiting examples of (suitable combinations of) such framework sequences will become clear from the further disclosure herein.

The invention also provides compounds and constructs, and in particular proteins and polypeptides (also referred to herein as "compound of the invention", "construct of the invention" and "polypeptide of the invention"), that comprise or essentially consists of at least one such amino acid sequence and/or Nanobody of the invention (or suitable fragments thereof), and optionally further comprises one or more other groups, residues, moieties or binding units. As will become clear to the skilled person from the further disclosure herein, such further groups, residues, moieties, binding units or amino acid sequences may or may not provide further functionality to the amino acid sequence and/or Nanobody of the invention (and/or to the compound or construct in which it is present) and may or may not modify the properties of the amino acid sequence and/or Nanobody of the invention.

As will be clear from the further description above and herein, this means that the amino acid sequences of the invention can be used as "building blocks" to form polypeptides (preferably biparatopic or multiparatopic polypeptides) of the invention, i.e. by suitably combining them with other groups, residues, moieties or binding units, in order to form compounds or constructs as described herein (such as, without limitations, the bi/multiparatopic. bi/multivalent and bi/multispecific polypeptides of the invention described herein) which combine within one molecule one or more desired properties or biological functions.

The compounds or polypeptides of the invention can generally be prepared by a method which comprises at least one step of suitably linking the one or more amino acid sequences and/or Nanobodies of the invention to the one or more further groups, residues, moieties or binding units, optionally via the one or more suitable linkers, so as to provide the compound or polypeptide of the invention. Polypeptides of the invention can also be prepared by a method which generally comprises at least the steps of providing a nucleic acid that encodes a polypeptide of the invention, expressing said nucleic acid in a suitable manner, and recovering the expressed polypeptide of the invention. Such methods can be performed in a manner known per se, which will be clear to the skilled person, for example on the basis of the methods and techniques further described herein.

Accordingly, the present invention also relates to the use of a monovalent construct (which may comprise or essentially consists of an amino acid sequence such as a domain antibody, an amino acid sequence that is suitable for use as a domain antibody, a single domain antibody, an amino acid sequence that is suitable for use as a single domain antibody, a "dAb", an amino acid sequences that is suitable for use as a dAb, or a Nanobody) in providing and/or preparing a multivalent (such as multiparatopic, and preferably biparatopic) compound, construct or polypeptide. The monovalent construct that is used as a binding domain or binding unit may comprise or essentially consists of any amino acid sequences and/or Nanobodies that is capable of binding to at least one antigenic determinant, epitope, part or domain on IL-6R. Preferred amino acid sequences and/or Nanobodies are e.g. described in WO 08/020,079 and/or are described herein (referred to herein as "amino acid sequence of the invention" and "Nanobody of the invention").

The monovalent construct that is used as a binding domain or binding unit may bind any antigenic determinant, epitope, part or domain on IL-6R. In a preferred aspect, the monovalent construct binds an epitope present in the extracellular D1 domain and/or it may be capable of specifically binding IL-6R while not binding the hybrid IL-6R (as described in Example 3; SEQ ID NO: 131); or it may be capable of binding an epitope present in the extracellular D2 domain and/or D3 domain and/or it may be capable of specifically binding IL-6R as well as the hybrid IL-6R (as described in Example 3; SEQ ID NO: 131). For example, the monovalent construct may be directed against the IL-6 binding site on IL-6R. In particular it may be directed against one or more of the 18 contact residues as described in Boulanger et al. 2003 (Science 300, 2101-2104) present in the extracellular D3 domain of the IL-6R, more preferably against amino acid residues Phe229 and Phe279 present in the extracellular D3 domain of the IL-6R) and/or it may be capable of competing with IL-6 for binding to IL-6R; the monovalent construct may be directed against the gp130 binding site on IL-6R and/or the IL-6/IL-6R complex and/or may be capable of competing with gp130 for binding to the IL-6/IL-6R complex; the monovalent construct may be directed against the Tocilizumab (MRA) binding site on IL-6R and/or may be capable of competing with Tocilizumab (MRA) for binding to IL-6R; the monovalent construct may be directed against the M182 binding site on IL-6R and/or may be capable of competing with M182 for binding to IL-6R; and/or the monovalent construct may be directed against the BN-12 binding site on IL-6R and/or may be capable of competing with BN-12 for binding to IL-6R.

As discussed above, the at least one further amino acid sequence and/or Nanobody that is used as a binding domain or binding unit in providing and/or preparing a multiparatopic (such as biparatopic) construct of the invention may be any amino acid sequence and/or Nanobody that is directed against and/or capable of binding IL-6R. In a preferred but non-limiting aspect, the at least one further amino acid sequence and/or Nanobody binds an epitope present in the extracellular D1 domain and/or it may be capable of capable of specifically binding IL-6R while not binding the hybrid IL-6R (as described in Example 3; SEQ ID NO: 131); or it may be capable of binding an epitope present in the extracellular D2 domain and/or D3 domain and/or it may be capable of specifically binding IL-6R as well as the hybrid IL-6R (as described in Example 3; SEQ ID NO: 131). In another preferred but non-limiting aspect, the at least one further amino acid sequence and/or Nanobody may be directed against the IL-6 binding site on IL-6R. In particular it may be directed against one or more of the 18 contact residues as described in Boulanger et al. 2003 (Science 300, 2101-2104) present in the extracellular D3 domain of the IL-6R, more preferably against amino acid residues Phe229 and Phe279 present in the extracellular D3 domain of the IL-6R) and/or it may be capable of competing with IL-6 for binding to IL-6R; the at least one further amino acid sequence and/or Nanobody may be directed against the gp130 binding site on IL-6R and/or the IL-6/IL-6R complex and/or may be capable of competing with gp130 for binding to the IL-6/IL-6R complex; the at least one further amino acid sequence and/or Nanobody may be directed against the Tocilizumab (MRA) binding site on IL-6R and/or may be capable of competing with Tocilizumab (MRA) for binding to IL-6R; the at least one further amino acid sequence and/or Nanobody may be directed against the M182 binding site on IL-6R and/or may be capable of competing with M182 for binding to IL-6R; and/or the at least one further amino acid sequence and/or Nanobody may be directed against the BN-12 binding site on IL-6R and/or may be capable of competing with BN-12 for binding to IL-6R.

In a preferred aspect the monovalent constructs, amino acid sequences and/or Nanobodies used in the preparation of the multiparatopic, and preferably biparatopic polypeptides of the invention are monovalent constructs, amino acid sequences and/or Nanobodies of the invention as described herein. More preferably, the monovalent constructs, amino acid sequences and/or Nanobodies used in the preparation of the multiparatopic, and preferably biparatopic polypeptides of the invention are selected from SEQ ID NO's: 132-216.

Accordingly the present invention also relates to the use of an amino acid sequence selected from SEQ ID NO's: 132-216 for preparing a multiparatopic, and preferably biparatopic polypeptides of the invention. Some preferred biparatopic polypeptides of the invention may be chosen from SEQ ID NO's: 828-963.

The present invention also relates to the use of a nucleic acid or nucleotide sequence that encodes a monovalent construct of the invention for the preparation of a genetic construct (as further defined herein) that encodes a multivalent (such as multiparatopic, and preferably biparatopic) construct.

In the multiparatopic (preferably biparatopic) polypeptide of the invention that comprises Nanobodies directed against two or more (preferably two) different antigenic determinants on IL-6R (for example against different epitopes of IL-6R), the length and flexibility of the linker are preferably such that, when the multiparatopic (preferably biparatopic) polypeptide binds to IL-6R, at least two and preferably all of the Nanobodies that are present in the multiparatopic (preferably biparatopic) polypeptide can (simultaneously) bind to each of their intended antigenic determinants, epitopes, parts or domains, most preferably so as to allow binding with increased avidity and also intramolecular binding and/or recognition. Again, based on the disclosure herein, the skilled person will be able to determine the optimal linker(s) for use in a specific polypeptide of the invention, optionally after some limited routine experiments.

Also encompassed within the present invention are methods for preparing and generating multiparatopic (such as e.g. biparatopic, triparatopic, etc.) polypeptides of the invention. Methods for preparing and generating the multiparatopic (such as e.g. biparatopic, triparatopic, etc.) polypeptides of the invention will be clear to the skilled person based on the description herein and/or are as further described herein.

In another aspect, the invention relates to a nucleic acid that encodes an amino acid sequence, a Nanobody, a polypeptide, and preferably a biparatopic (or multiparatopic) polypeptide of the invention (or a suitable fragment thereof). Such a nucleic acid will also be referred to herein as a "nucleic acid of the invention" and may for example be in the form of a genetic construct, as further described herein. Again, as generally described herein for the nucleic acids of the invention, such a nucleic acid may be in the form of a genetic construct, as defined herein.

In another aspect, the invention relates to a host or host cell that expresses (or that under suitable circumstances is capable of expressing) an amino acid sequence, a Nanobody, a polypeptide, and preferably a biparatopic (or multiparatopic) polypeptide of the invention; and/or that contains a nucleic acid of the invention. Some preferred but non-limiting examples of such hosts or host cells will become clear from the further description herein.

Another aspect of the invention relates to a product or composition, such as pharmaceutical compositions, containing or comprising at least one amino acid sequence and/or Nanobody of the invention, at least one polypeptide and preferably biparatopic (or multiparatopic) polypeptide of the invention and/or at least one nucleic acid of the invention, and optionally one or more further components of such compositions known per se, i.e. depending on the intended use of the composition. Such a product or composition may for example be a pharmaceutical composition (as described herein), a veterinary composition or a product or composition for diagnostic use (as also described herein). Some preferred but non-limiting examples of such products or compositions will become clear from the further description herein.

The invention further relates to applications and uses of the amino acid sequences, Nanobodies, compounds, constructs, polypeptides, and preferably biparatopic (or multiparatopic) polypeptides, nucleic acids, host cells, products and compositions described herein, as well as to methods for the prevention and/or treatment for diseases and disorders associated with IL-6R. Some preferred but non-limiting applications and uses will become clear from the further description herein.

The amino acid sequences, Nanobodies, compounds, constructs, polypeptides, and preferably biparatopic (or multiparatopic) polypeptides, and compositions of the present invention can generally be used to modulate, and in particular inhibit and/or prevent, binding of IL-6R to IL-6 and/or binding of the IL-6/IL-6R complex to gp130 and thus to modulate, and in particular inhibit or prevent, the signalling that is mediated by IL-6R, IL-6, IL6/IL-6R complex or gp130 to modulate the biological pathways in which IL-6R, IL-6, the IL6/IL-6R complex and/or gp130 are involved, and/or to modulate the biological mechanisms, responses and effects associated with such signalling or these pathways.

In another aspect, the amino acid sequence, Nanobody, polypeptide and preferably biparatopic (or multiparatopic) polypeptide of the invention or the composition comprising the same is an antagonist of IL-6R and will inhibit, decrease, downregulate and/or block signalling mediated by IL-6, IL-6R, the IL-6/IL-6R complex and/or gp130 and/or the pathway(s) and/or mechanism(s) in which IL-6, IL-6R, the IL-6/IL-6R complex or gp130 are involved. In a preferred aspect, the amino acid sequence, Nanobody, polypeptide and preferably biparatopic (or multiparatopic) polypeptide of the invention or the composition comprising the same will inhibit, decrease, downregulate and/or block signalling mediated by IL-6, IL-6R, the IL-6/IL-6R complex and/or gp130 and/or the pathway(s) and/or mechanism(s) in which IL-6, IL-6R, the IL-6/IL-6R complex or gp130 are involved equally or better than the reference IgG and/or the reference Fab. In another preferred aspect, the amino acid sequence, Nanobody, polypeptide and preferably biparatopic (or multiparatopic) polypeptide of the invention or the composition comprising the same will inhibit, decrease, downregulate and/or block signalling mediated by IL-6, IL-6R, the IL-6/IL-6R complex and/or gp130 and/or the pathway(s) and/or mechanism(s) in which IL-6, IL-6R, the IL-6/IL-6R complex or gp130 are involved equally or better than Tocilizumab (MRA). In another preferred aspect, the amino acid sequence, Nanobody, polypeptide and preferably biparatopic (or multiparatopic) polypeptide of the invention or the composition comprising the same will inhibit, decrease, downregulate and/or block signalling mediated by IL-6, IL-6R, the IL-6/IL-6R complex and/or gp130 and/or the pathway(s) and/or mechanism(s) in which IL-6, IL-6R, the IL-6/IL-6R complex or gp130 are involved equally or better than M182.

The amino acid sequences, Nanobodies, polypeptide and preferably biparatopic (or multiparatopic) polypeptides and compositions of the invention are also preferably (but without limitation) such that they effect a decrease (i.e. by at least 1 percent such as by at least 10 percent, preferably by at least 30 percent, more preferably by at least 50 percent, even more preferably by at least 75 percent or more) or a total inhibition of the induction of C-reactive protein (CRP) in a mammal (such as in a human subject or in a suitable animal model for inflammation such as the a cynomologus monkey) when they are administered to said mammal in a therapeutically relevant amount compared to a mammal not receiving the amino acid sequence, Nanobody, polypeptide and preferably biparatopic (or multiparatopic) polypeptide, compound or composition of the invention. Preferably, the amino acid sequences, Nanobodies, polypeptides and preferably biparatopic (or multiparatopic) polypeptides and compositions comprising the same are (but without limitation) such that they effect a decrease of the induction of C-reactive protein (CRP) in a mammal (such as in a human subject or in a suitable animal model for inflammation such as the a cynomologus monkey) that is the same or better (at least 5%, preferably at least 10%, more preferably at least 20%, even more preferably at least 30% or more, such as at least 50% or more) compared to the decrease effected by the reference IgG and the reference Fab when administered to said mammal in a therapeutically relevant amount. Preferably, the amino acid sequences, Nanobodies, polypeptides and preferably biparatopic (or multiparatopic) polypeptides and compositions comprising the same are (but without limitation) such that they effect a decrease of the induction of C-reactive protein (CRP) in a mammal (such as in a human subject or in a suitable animal model for inflammation such as the a cynomologus monkey) that is the same or better (at least 5%, preferably at least 10%, more preferably at least 20%, even more preferably at least 30% or more, such as at least 50% or more) compared to the decrease effected by Tocilizumab (MRA) when administered to said mammal in a therapeutically relevant amount. Preferably, the amino acid sequences, Nanobodies, polypeptides and preferably biparatopic (or multiparatopic) polypeptides and compositions comprising the same are (but without limitation) such that they effect a decrease of the induction of C-reactive protein (CRP) in a mammal (such as in a human subject or in a suitable animal model for inflammation such as the a cynomologus monkey) that is the same or better (at least 5%, preferably at least 10%, more preferably at least 20%, even more preferably at least 30% or more, such as at least 50% or more) compared to the decrease effected by M182 when administered to said mammal in a therapeutically relevant amount.

The amino acid sequences, Nanobodies, polypeptides and preferably biparatopic (or multiparatopic) polypeptides and compositions comprising the same are also preferably (but without limitation) such that they effect a decrease (i.e. by at least 1 percent such as by at least 10 percent, preferably by at least 30 percent, more preferably by at least 50 percent, even more preferably by at least 75 percent or more) or a total inhibition of the induction of the platelet count in a mammal (such as in a human subject or in a suitable animal model for inflammation such as the a cynomologus monkey) when they are administered to said mammal in a therapeutically relevant amount compared to a mammal not receiving the amino acid sequence, Nanobody, polypeptide and preferably biparatopic (or multiparatopic) polypeptide or compositions comprising the same. Preferably, the amino acid sequences, Nanobodies, polypeptides and preferably biparatopic (or multiparatopic) polypeptides and compositions comprising the same are (but without limitation) such that they effect a decrease of the induction of the platelet count in a mammal (such as in a human subject or in a suitable animal model for inflammation such as the a cynomologus monkey) that is the same or better (at least 5%, preferably at least 10%, more preferably at least 20%, even more preferably at least 30% or more, such as at least 50% or more) compared to the decrease effected by the reference IgG and/or the reference Fab when administered to said mammal in a therapeutically relevant amount. Preferably, the amino acid sequences, Nanobodies, polypeptides and preferably biparatopic (or multiparatopic) polypeptides and compositions comprising the same are (but without limitation) such that they effect a decrease of the induction of the platelet count in a mammal (such as in a human subject or in a suitable animal model for inflammation such as the a cynomologus monkey) that is the same or better (at least 5%, preferably at least 10%, more preferably at least 20%, even more preferably at least 30% or more, such as at least 50% or more) compared to the decrease effected by Tocilizumab (MRA) when administered to said mammal in a therapeutically relevant amount. Preferably, the amino acid sequences, Nanobodies, polypeptides and preferably biparatopic (or multiparatopic) polypeptides and compositions comprising the same are (but without limitation) such that they effect a decrease of the induction of the platelet count in a mammal (such as in a human subject or in a suitable animal model for inflammation such as the a cynomologus monkey) that is the same or better (at least 5%, preferably at least 10%, more preferably at least 20%, even more preferably at least 30% or more, such as at least 50% or more) compared to the decrease effected by M182 when administered to said mammal in a therapeutically relevant amount.

The amino acid sequences, Nanobodies, polypeptides and preferably biparatopic (or multiparatopic) polypeptides and compositions comprising the same are also preferably (but without limitation) such that they effect a decrease (i.e. by at least 1 percent such as by at least 10 percent, preferably by at least 30 percent, more preferably by at least 50 percent, even more preferably by at least 75 percent or more) or a total inhibition of the induction of fibrinogen in a mammal (such as in a human subject or in a suitable animal model for inflammation such as the cynomologus monkey) when they are administered to said mammal in a therapeutically relevant amount compared to a mammal not receiving the amino acid sequence, Nanobody, polypeptide and preferably biparatopic (or multiparatopic) polypeptide or compositions comprising the same. Preferably, the amino acid sequences, Nanobodies, polypeptides and preferably biparatopic (or multiparatopic) polypeptides and compositions comprising the same are (but without limitation) such that they effect a decrease of the induction of fibrinogen in a mammal (such as in a human subject or in a suitable animal model for inflammation such as the a cynomologus monkey) that is the same or better (at least 5%, preferably at least 10%, more preferably at least 20%, even more preferably at least 30% or more, such as at least 50% or more) compared to the decrease effected by the reference IgG and/or the reference Fab when administered to said mammal in a therapeutically relevant amount. Preferably, the amino acid sequences, Nanobodies, polypeptides and preferably biparatopic (or multiparatopic) polypeptides and compositions comprising the same are (but without limitation) such that they effect a decrease of the induction of fibrinogen in a mammal (such as in a human subject or in a suitable animal model for inflammation such as the a cynomologus monkey) that is the same or better (at least 5%, preferably at least 10%, more preferably at least 20%, even more preferably at least 30% or more, such as at least 50% or more) compared to the decrease effected by Tocilizumab (MRA) when administered to said mammal in a therapeutically relevant amount. Preferably, the amino acid sequences, Nanobodies, polypeptides and preferably biparatopic (or multiparatopic) polypeptides and compositions comprising the same are (but without limitation) such that they effect a decrease of the induction of the fibrinogen in a mammal (such as in a human subject or in a suitable animal model for inflammation such as the a cynomologus monkey) that is the same or better (at least 5%, preferably at least 10%, more preferably at least 20%, even more preferably at least 30% or more, such as at least 50% or more) compared to the decrease effected by M182 when administered to said mammal in a therapeutically relevant amount.

As such, the amino acid sequences, Nanobodies, compounds, constructs, polypeptides, and preferably biparatopic (or multiparatopic) polypeptides, and compositions of the invention can be used for the prevention and treatment of diseases and disorders associated with IL-6R, IL-6 and/or with the IL-6/IL-6R complex (optionally in further complex with gp130), and/or with the signaling pathway(s) and/or the biological functions and responses in which IL-6 and/or the IL-6/IL-6R complex (optionally in further complex with gp130) are involved, and in particular for the prevention and treatment of diseases and disorders associated with IL-6R, IL-6 and/or with the IL-6/IL-6R complex (optionally in further complex with gp130), and/or with the signaling pathway(s) and/or the biological functions and responses in which IL-6R, IL-6 and/or with the IL-6/IL-6R complex (optionally in further complex with gp130) are involved, which are characterized by excessive and/or unwanted signalling mediated by IL-6R or by the pathway(s) in which IL-6R is involved. Examples of such diseases and disorders associated with IL-6R, IL-6 and/or with the IL-6/IL-6R complex, and/or with the signaling pathway(s) and/or the biological functions and responses in which IL-6 and/or the IL-6/IL-6R complex are involved, will be clear to the skilled person based on the disclosure herein, and for example include the following diseases and disorders: sepsis (Starnes et al., 1999) and various forms of cancer such as multiple myeloma disease (MM), renal cell carcinoma (RCC), plasma cell leukaemia (Klein et al., 1991), lymphoma, B-lymphoproliferative disorder (BLPD) and prostate cancer. Non-limiting examples of other diseases caused by excessive IL-6 production or signalling include bone resorption (osteoporosis) (Roodman et al., 1992; Jilka et al., 1992), cachexia (Strassman et al., 1992), psoriasis, mesangial proliferative glomerulonephritis, Kaposi's sarcoma, AIDS-related lymphoma (Emilie et al., 1994), inflammatory diseases and disorder such as rheumatoid arthritis, systemic onset juvenile idiopathic arthritis, hypergammaglobulinemia (Grau et al., 1990); Crohn's disease, ulcerative colitis, systemic lupus erythematosus (SLE), multiple sclerosis, Castleman's disease, IgM gammopathy, cardiac myxoma, asthma (in particular allergic asthma) and autoimmune insulin-dependent diabetes mellitus (Campbell et al., 1991). Other IL-6R, IL-6 and/or IL-6/IL-6R complex related disorders will be clear to the skilled person. Such diseases and disorders are also generally referred to herein as "IL-6R related disorders".

The invention also relates to the amino acid sequences, compounds, constructs, polypeptides, and preferably biparatopic (or multiparatopic) polypeptides, nucleic acids, host cells, products and compositions described herein for use in therapy.

In particular, the invention also relates to the amino acid sequences, compounds, constructs, polypeptides, and preferably biparatopic (or multiparatopic) polypeptides, nucleic acids, host cells, products and compositions described herein for use in therapy of a disease or disorder that can be prevented or treated by administering, to a subject in need thereof, of (a pharmaceutically effective amount of) an amino acid sequence, compound, construct or polypeptide as described herein.

More in particular, the invention relates to the amino acid sequences, compounds, constructs, polypeptides, and preferably biparatopic (or multiparatopic) polypeptides nucleic acids, host cells, products and compositions described herein for use in therapy of various diseases and disorders, such as sepsis (Starnes et al., 1999) and various forms of cancer such as multiple myeloma disease (MM), renal cell carcinoma (RCC), plasma cell leukaemia (Klein et al., 1991), lymphoma, B-lymphoproliferative disorder (BLPD) and prostate cancer. Non-limiting examples of other diseases caused by excessive IL-6 production or signalling include bone resorption (osteoporosis) (Roodman et al., 1992; Jilka et al., 1992), cachexia (Strassman et al., 1992), psoriasis, mesangial proliferative glomerulonephritis, Kaposi's sarcoma, AIDS-related lymphoma (Emilie et al., 1994), inflammatory diseases and disorder such as rheumatoid arthritis, systemic onset juvenile idiopathic arthritis, hypergammaglobulinemia (Grau et al., 1990); Crohn's disease, ulcerative colitis, systemic lupus erythematosus (SLE), multiple sclerosis, Castleman's disease, IgM gammopathy, cardiac myxoma, asthma (in particular allergic asthma) and autoimmune insulin-dependent diabetes mellitus (Campbell et al., 1991).

Other applications and uses of the amino acid sequences, Nanobodies, compounds, constructs, polypeptides, and preferably biparatopic (or multiparatopic) polypeptides, and compositions of the invention will become clear to the skilled person from the further disclosure herein.

Other aspects, embodiments, advantages and applications of the invention will also become clear from the further description herein, in which the invention will be described and discussed in more detail with reference to the amino acid sequences, Nanobodies of the invention and polypeptides, and preferably biparatopic (or multiparatopic) polypeptides of the invention comprising the same, which form some of the preferred aspects of the invention.

Generally, it is an object of the invention to provide pharmacologically active agents, as well as compositions comprising the same, that can be used in the diagnosis, prevention and/or treatment of one or more IL-6R related disorders (as defined herein); and to provide methods for the diagnosis, prevention and/or treatment of such diseases and disorders that involve the administration and/or use of such agents and compositions.

More in particular, it is an object of the invention to provide therapeutic proteins that can be used as pharmacologically active agents, as well as compositions comprising the same, for the diagnosis, prevention and/or treatment of one or more IL-6R related disorders (as defined herein); and to provide methods for the diagnosis, prevention and/or treatment of such diseases and disorders that involve the administration and/or the use of such therapeutic proteins and compositions.

In the invention, generally, these objects are achieved by the use of the amino acid sequences, Nanobodies, compounds, constructs, polypeptides, and preferably biparatopic (or multiparatopic) polypeptides, and compositions that are described herein.

As will become clear from the further description herein, Nanobodies generally offer certain advantages (outlined herein) compared to "dAb's" or similar (single) domain antibodies or immunoglobulin sequences, which advantages are also provided by the Nanobodies of the invention. However, it will be clear to the skilled person that the more general aspects of the teaching below can also be applied (either directly or analogously) to other amino acid sequences of the invention.

BRIEF DESCRIPTION OF THE DRAWINGS

FIG. 1: Hybrid IL-6R amino acid sequence (SEQ ID NO: 131).

DETAILED DESCRIPTION

Figure 2A:
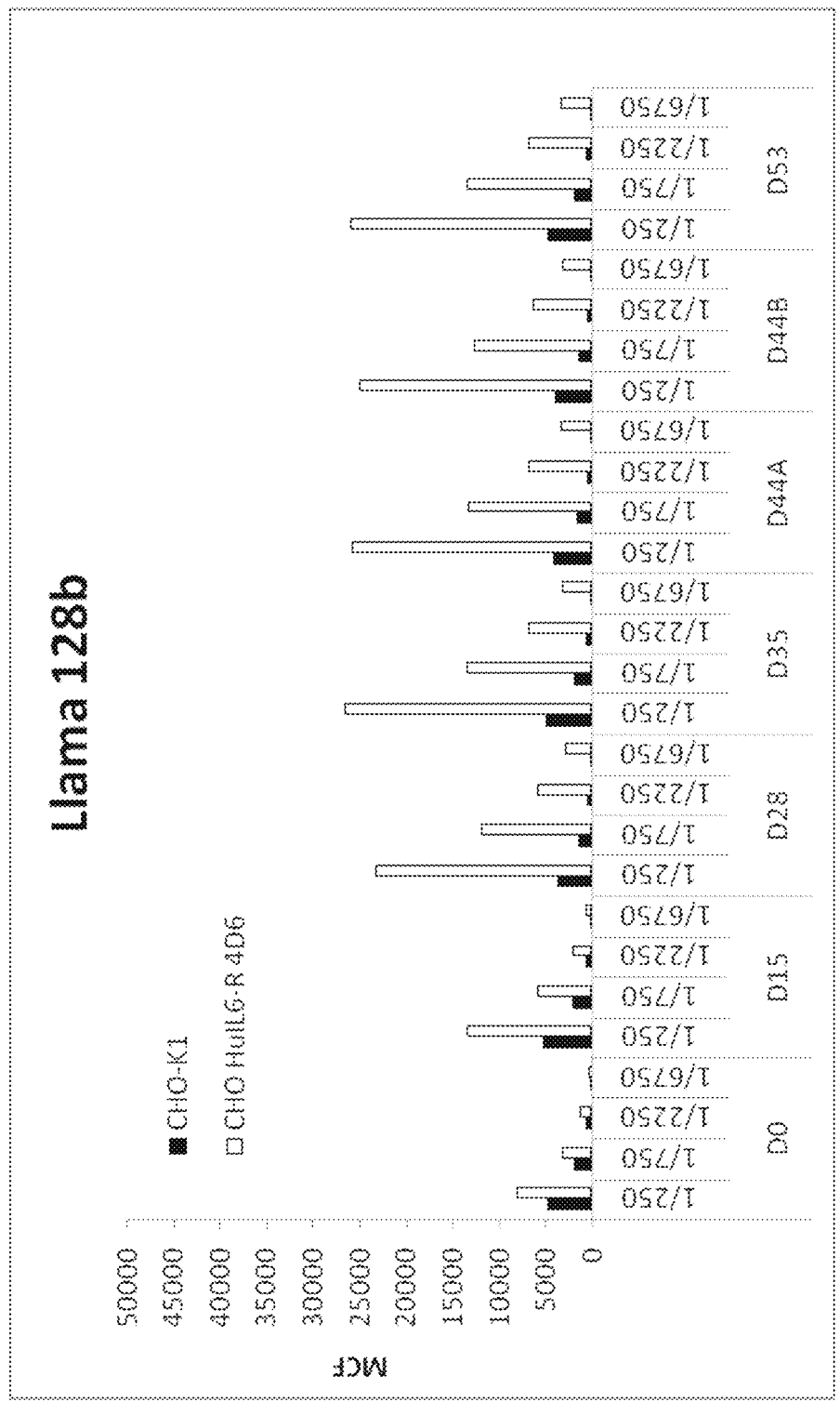
FIG. 2 Analysis of immune response in llamas 128b, 129b and 130b by FACS analysis. Antigen specific serum titer is shown of llama 128b (FIG. 2a), llama 129b (FIG. 2b) and llama 130b (FIG. 2c) on IL-6R-transfected CHO cells. The total IgG (conventional and heavy chain antibody mediated) was measured. (CHO-K1 is shown on the left hand side and CHO HuIL6-R 4D6 is shown on the right hand side of each bar-graph pair)

In the present description, examples and claims:
a) Unless indicated or defined otherwise, all terms used have their usual meaning in the art, which will be clear to the skilled person. Reference is for example made to the standard handbooks mentioned in paragraph a) on page 46 of WO 08/020,079.
b) Unless indicated otherwise, the terms "immunoglobulin sequence", "sequence", "nucleotide sequence" and "nucleic acid" are as described in paragraph b) on page 46 of WO 08/020,079.
c) Unless indicated otherwise, all methods, steps, techniques and manipulations that are not specifically described in detail can be performed and have been performed in a manner known per se, as will be clear to the skilled person. Reference is for example again made to the standard handbooks and the general background art mentioned herein and to the further references cited therein; as well as to for example the following reviews Presta, Adv. Drug Deliv. Rev. 2006, 58 (5-6): 640-56; Levin and Weiss, Mol. Biosyst. 2006, 2(1): 49-57; Irving et al., J. Immunol. Methods, 2001, 248(1-2), 31-45; Schmitz et al., Placenta, 2000, 21 Suppl. A, 5106-12, Gonzales et al., Tumour Biol., 2005, 26(1), 31-43, which describe techniques for protein engineering, such as affinity maturation and other techniques for improving the specificity and other desired properties of proteins such as immunoglobulins.
d) Amino acid residues will be indicated according to the standard three-letter or one-letter amino acid code. Reference is made to Table A-2 on page 48 of the International application WO 08/020,079 of Ablynx N.V. entitled "Amino acid sequences directed against IL-6R and polypeptides comprising the same for the treatment of diseases and disorders associated with Il-6 mediated signalling".
e) For the purposes of comparing two or more nucleotide sequences, the percentage of "sequence identity" between a first nucleotide sequence and a second nucleotide sequence may be calculated or determined as described in paragraph e) on page 49 of WO 08/020,079 (incorporated herein by reference), such as by dividing [the number of nucleotides in the first nucleotide sequence that are identical to the nucleotides at the corresponding positions in the second nucleotide sequence] by [the total number of nucleotides in the first nucleotide sequence] and multiplying by [100%], in which each deletion, insertion, substitution or addition of a nucleotide in the second nucleotide sequence—compared to the first nucleotide sequence—is considered as a difference at a single nucleotide (position); or using a suitable computer algorithm or technique, again as described in paragraph e) on pages 49 of WO 08/020,079 (incorporated herein by reference).
f) For the purposes of comparing two or more amino acid sequences, the percentage of "sequence identity" between a first amino acid sequence and a second amino acid sequence (also referred to herein as "amino acid identity") may be calculated or determined as described in paragraph f) on pages 49 and 50 of WO 08/020,079 (incorporated herein by reference), such as by dividing [the number of amino acid residues in the first amino acid sequence that are identical to the amino acid residues at the corresponding positions in the second amino acid sequence] by [the total number of amino acid residues in the first amino acid sequence] and multiplying by [100%], in which each deletion, insertion, substitution or addition of an amino acid residue in the second amino acid sequence—compared to the first amino acid sequence—is considered as a difference at a single amino acid residue (position), i.e. as an "amino acid difference" as defined herein; or using a suitable computer algorithm or technique, again as described in paragraph f) on pages 49 and 50 of WO 08/020,079 (incorporated herein by reference).

Also, in determining the degree of sequence identity between two amino acid sequences, the skilled person may take into account so-called "conservative" amino acid substitutions, as described on page 50 of WO 08/020,079.

Any amino acid substitutions applied to the polypeptides described herein may also be based on the analysis of the frequencies of amino acid variations between homologous proteins of different species developed by Schulz et al., Principles of Protein Structure, Springer-Verlag, 1978, on the analyses of structure forming potentials developed by Chou and Fasman, Biochemistry 13: 211, 1974 and Adv. Enzymol., 47: 45-149, 1978, and on the analysis of hydrophobicity patterns in proteins developed by Eisenberg et al., Proc. Natl. Acad. Sci. USA 81: 140-144, 1984; Kyte & Doolittle; J. Molec. Biol. 157: 105-132, 198 1, and Goldman et al., Ann. Rev. Biophys. Chem. 15: 321-353, 1986, all incorporated herein in their entirety by reference. Information on the primary, secondary and tertiary structure of Nanobodies is given in the description herein and in the general background art cited above. Also, for this purpose, the crystal structure of a $V_{HH}$ domain from a llama is for example given by Desmyter et al., Nature Structural Biology, Vol. 3, 9, 803 (1996); Spinelli et al., Natural Structural Biology (1996); 3, 752-757; and Decanniere et al., Structure, Vol. 7, 4, 361 (1999). Further information about some of the amino acid residues that in conventional $V_H$ domains form the $V_H/V_L$ interface and potential camelizing substitutions on these positions can be found in the prior art cited above.

g) Amino acid sequences and nucleic acid sequences are said to be "exactly the same" if they have 100% sequence identity (as defined herein) over their entire length.
h) When comparing two amino acid sequences, the term "amino acid difference" refers to an insertion, deletion or substitution of a single amino acid residue on a position of the first sequence, compared to the second sequence; it being understood that two amino acid sequences can contain one, two or more such amino acid differences.
i) When a nucleotide sequence or amino acid sequence is said to "comprise" another nucleotide sequence or amino acid sequence, respectively, or to "essentially consist of" another nucleotide sequence or amino acid sequence, this has the meaning given in paragraph i) on pages 51-52 of WO 08/020,079.
j) The term "in essentially isolated form" has the meaning given to it in paragraph j) on pages 52 and 53 of WO 08/020,079.

k) The terms "domain" and "binding domain" have the meanings given to it in paragraph k) on page 53 of WO 08/020,079.
l) The terms "antigenic determinant" and "epitope", which may also be used interchangeably herein, have the meanings given to it in paragraph l) on page 53 of WO 08/020,079.
m) As further described in paragraph m) on page 53 of WO 08/020,079, an amino acid sequence (such as a Nanobody, an antibody, a polypeptide and preferably a biparatopic (or multiparatopic) polypeptide of the invention, or generally an antigen binding protein or polypeptide or a fragment thereof) that can (specifically) bind to, that has affinity for and/or that has specificity for a specific antigenic determinant, epitope, antigen or protein (or for at least one part, fragment or epitope thereof) is said to be "against" or "directed against" said antigenic determinant, epitope, antigen or protein.
n) The term "specificity" has the meaning given to it in paragraph n) on pages 53-56 of WO 08/020,079; and as mentioned therein refers to the number of different types of antigens or antigenic determinants to which a particular antigen-binding molecule or antigen-binding protein (such as a Nanobody or a polypeptide of the invention) molecule can bind. The specificity of an antigen-binding protein can be determined based on affinity and/or avidity, as described on pages 53-56 of WO 08/020,079 (incorporated herein by reference), which also describes some preferred techniques for measuring binding between an antigen-binding molecule (such as a Nanobody or polypeptide and preferably a biparatopic (or multiparatopic) polypeptide of the invention) and the pertinent antigen. Typically, antigen-binding proteins (such as the amino acid sequences, Nanobodies and/or polypeptides and preferably biparatopic (or multiparatopic) polypeptides of the invention) will bind to their antigen with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles). Any $K_D$ value greater than $10^4$ mol/liter (or any $K_A$ value lower than $10^4$ $M^{-1}$) liters/mol is generally considered to indicate non-specific binding. Preferably, a monovalent immunoglobulin sequence of the invention will bind to the desired antigen with an affinity less than 500 nM, preferably less than 200 nM, more preferably less than 10 nM, such as less than 500 µM. Specific binding of an antigen-binding protein to an antigen or antigenic determinant can be determined in any suitable manner known per se, including, for example, Scatchard analysis and/or competitive binding assays, such as radioimmunoassays (RIA), enzyme immunoassays (EIA) and sandwich competition assays, and the different variants thereof known per se in the art; as well as the other techniques mentioned herein. As will be clear to the skilled person, and as described on pages 53-56 of WO 08/020,079, the dissociation constant may be the actual or apparent dissociation constant. Methods for determining the dissociation constant will be clear to the skilled person, and for example include the techniques mentioned on pages 53-56 of WO 08/020,079.
o) The half-life of an amino acid sequence, compound, polypeptide and preferably a biparatopic (or multiparatopic) polypeptide of the invention can generally be defined as described in paragraph o) on page 57 of WO 08/020,079 and as mentioned therein refers to the time taken for the serum concentration of the amino acid sequence, compound, polypeptide or preferably biparatopic (or multiparatopic) polypeptide to be reduced by 50%, in vivo, for example due to degradation of the sequence or compound and/or clearance or sequestration of the sequence or compound by natural mechanisms. The in vivo half-life of an amino acid sequence, compound, polypeptide and preferably a biparatopic (or multiparatopic) polypeptide of the invention can be determined in any manner known per se, such as by pharmacokinetic analysis. Suitable techniques will be clear to the person skilled in the art, and may for example generally be as described in paragraph o) on page 57 of WO 08/020,079. As also mentioned in paragraph o) on page 57 of WO 08/020,079, the half-life can be expressed using parameters such as the t1/2-alpha, t1/2-beta and the area under the curve (AUC). Reference is for example made to the Experimental Part below, as well as to the standard handbooks, such as Kenneth, A et al: Chemical Stability of Pharmaceuticals: A Handbook for Pharmacists and Peters et al, Pharmacokinete analysis: A Practical Approach (1996). Reference is also made to "Pharmacokinetics", M Gibaldi & D Perron, published by Marcel Dekker, 2nd Rev. edition (1982). The terms "increase in half-life" or "increased half-life" as also as defined in paragraph o) on page 57 of WO 08/020,079 and in particular refer to an increase in the t1/2-beta, either with or without an increase in the t1/2-alpha and/or the AUC or both.
p) In the context of the present invention, "modulating" or "to modulate" generally means either reducing or inhibiting the activity of, or alternatively increasing the activity of, a target or antigen, as measured using a suitable in vitro, cellular or in vivo assay. In particular, "modulating" or "to modulate" may mean either reducing or inhibiting the activity of, or alternatively increasing a (relevant or intended) biological activity of, a target or antigen, as measured using a suitable in vitro, cellular or in vivo assay (which will usually depend on the target or antigen involved), by at least 1%, preferably at least 5%, such as at least 10% or at least 25%, for example by at least 50%, at least 60%, at least 70%, at least 80%, or 90% or more, compared to activity of the target or antigen in the same assay under the same conditions but without the presence of the construct of the invention.

As will be clear to the skilled person, "modulating" may also involve effecting a change (which may either be an increase or a decrease) in affinity, avidity, specificity and/or selectivity of a target or antigen for one or more of its ligands, binding partners, partners for association into a homomultimeric or heteromultimeric form, or substrates; and/or effecting a change (which may either be an increase or a decrease) in the sensitivity of the target or antigen for one or more conditions in the medium or surroundings in which the target or antigen is present (such as pH, ion strength, the presence of co-factors, etc.), compared to the same conditions but without the presence of the construct of the invention. As will be clear to the skilled person, this may again be determined in any suitable manner and/or using any suitable assay known per se, depending on the target or antigen involved.

"Modulating" may also mean effecting a change (i.e. an activity as an agonist, as an antagonist or as a reverse agonist, respectively, depending on the target or antigen and the desired biological or physiological effect) with respect to one or more biological or physiological mechanisms, effects, responses, functions, pathways or activities in which the target or antigen (or in which its substrate(s), ligand(s) or pathway(s) are involved, such as its signalling pathway or metabolic pathway and their associated biological or physiological effects) is involved. Again, as will be clear to the skilled person, such an action as an agonist or an antagonist may be determined in any suitable manner and/or using any suitable (in vitro and usually cellular or in assay) assay known per se, depending on the target or antigen involved. In particular, an action as an agonist or antagonist may be such that an intended biological or physiological activity is increased or decreased, respectively, by at least 1%, preferably at least 5%, such as at least 10% or at least 25%, for example by at least 50%, at least 60%, at least 70%, at least 80%, or 90% or more, compared to the biological or physiological activity in the same assay under the same conditions but without the presence of the construct of the invention.

Modulating may for example also involve allosteric modulation of the target or antigen; and/or reducing or inhibiting the binding of the target or antigen to one of its substrates or ligands and/or competing with a natural ligand, substrate for binding to the target or antigen. Modulating may also involve activating the target or antigen or the mechanism or pathway in which it is involved. Modulating may for example also involve effecting a change in respect of the folding or confirmation of the target or antigen, or in respect of the ability of the target or antigen to fold, to change its confirmation (for example, upon binding of a ligand), to associate with other (sub)units, or to disassociate. Modulating may for example also involve effecting a change in the ability of the target or antigen to transport other compounds or to serve as a channel for other compounds (such as ions).

Modulating may be reversible or irreversible, but for pharmaceutical and pharmacological purposes will usually be in a reversible manner.

q) In respect of a target or antigen, the term "interaction site" on the target or antigen means a site, epitope, antigenic determinant, part, domain or stretch of amino acid residues on the target or antigen that is a site for binding to a ligand, receptor or other binding partner, a catalytic site, a cleavage site, a site for allosteric interaction, a site involved in multimerisation (such as homomerization or heterodimerization) of the target or antigen; or any other site, epitope, antigenic determinant, part, domain or stretch of amino acid residues on the target or antigen that is involved in a biological action or mechanism of the target or antigen. More generally, an "interaction site" can be any site, epitope, antigenic determinant, part, domain or stretch of amino acid residues on the target or antigen to which an amino acid sequence or polypeptide of the invention can bind such that the target or antigen (and/or any pathway, interaction, signalling, biological mechanism or biological effect in which the target or antigen is involved) is modulated (as defined herein).

r) An amino acid sequence or polypeptide is said to be "specific for" a first target or antigen compared to a second target or antigen when is binds to the first antigen with an affinity (as described above, and suitably expressed as a $K_D$ value, $K_A$ value, $K_{off}$ rate and/or $K_{on}$ rate) that is at least 10 times, such as at least 100 times, and preferably at least 1000 times, and up to 10.000 times or more better than the affinity with which said amino acid sequence or polypeptide binds to the second target or polypeptide. For example, the first antigen may bind to the target or antigen with a $K_D$ value that is at least 10 times less, such as at least 100 times less, and preferably at least 1000 times less, such as 10.000 times less or even less than that, than the $K_D$ with which said amino acid sequence or polypeptide binds to the second target or polypeptide. Preferably, when an amino acid sequence or polypeptide is "specific for" a first target or antigen compared to a second target or antigen, it is directed against (as defined herein) said first target or antigen, but not directed against said second target or antigen.

s) The terms "cross-block", "cross-blocked" and "cross-blocking" are used interchangeably herein to mean the ability of an amino acid sequence or other binding agents (such as a Nanobody, polypeptide and preferably biparatopic (or multiparatopic) polypeptide or compound or construct of the invention) to interfere with the binding of other amino acid sequences or binding agents of the invention to a given target. The extend to which an amino acid sequence or other binding agents of the invention is able to interfere with the binding of another to IL-6R, and therefore whether it can be said to cross-block according to the invention, can be determined using competition binding assays. One particularly suitable quantitative cross-blocking assay uses a Biacore machine which can measure the extent of interactions using surface plasmon resonance technology. Another suitable quantitative cross-blocking assay uses an ELISA-based approach to measure competition between amino acid sequences or other binding agents in terms of their binding to the target.

The following generally describes a suitable Biacore assay for determining whether an amino acid sequence or other binding agent cross-blocks or is capable of cross-blocking according to the invention. It will be appreciated that the assay can be used with any of the amino acid sequences or other binding agents described herein. The Biacore machine (for example the Biacore 3000) is operated in line with the manufacturer's recommendations. Thus in one cross-blocking assay, the target protein is coupled to a CM5 Biacore chip using standard amine coupling chemistry to generate a surface that is coated with the target. Typically 200-800 resonance units of the target would be coupled to the chip (an amount that gives easily measurable levels of binding but that is readily saturable by the concentrations of test reagent being used). Two test amino acid sequences (termed A* and B*) to be assessed for their ability to cross-block each other are mixed at a one to one molar ratio of binding sites in a suitable buffer to create the test mixture. When calculating the concentrations on a binding site basis the molecular weight of an amino acid sequence is assumed to be the total molecular weight of the amino acid sequence divided by the number of target binding sites on that amino acid sequence. The concentration of each amino acid sequence in the test mix should be high enough to readily saturate the binding sites for that amino acid sequence on the target molecules captured on the Biacore chip. The amino acid sequences in the mixture are at the same molar concentration (on a binding basis) and that concentration would typically be between 1.00 and 1.5 micromolar (on a binding site basis). Separate solutions containing A* alone and B* alone are also prepared. A* and B* in these solutions should be in the same buffer and at the same concentration as in the test mix. The test mixture is passed over the target-coated Biacore chip and the total amount of binding recorded. The chip is then treated in such a way as to remove the bound amino acid sequences without damaging the chip-bound target. Typically this is done by treating the chip with 30 mM HCl for 60 seconds. The solution of A* alone is then passed over the target-coated surface and the amount of binding recorded. The chip is again treated to remove all of the bound amino acid sequences without damaging the chip-bound target. The solution of B* alone is then passed over the target-coated surface and the amount of binding recorded. The maximum theoretical binding of the mixture of A* and B* is next calculated, and is the sum of the binding of each amino acid sequence when passed over the target surface alone. If the actual recorded binding of the mixture is less than this theoretical maximum then the two amino acid sequences are cross-blocking each other. Thus, in general, a cross-blocking amino acid sequence or other binding agent according to the invention is one which will bind to the target in the above Biacore cross-blocking assay such that, during the assay and in the presence of a second amino acid sequence or other binding agent of the invention, the recorded binding is between 80% and 0.1% (e.g. 80% to 4%) of the maximum theoretical binding, specifically between 75% and 0.1% (e.g. 75% to 4%) of the maximum theoretical binding, and more specifically between 70% and 0.1% (e.g. 70% to 4%) of maximum theoretical binding (as just defined above) of the two amino acid sequences or binding agents in combination. The Biacore assay described above is a primary assay used to determine if amino acid sequences or other binding agents cross-block each other according to the invention. On rare occasions particular amino acid sequences or other binding agents may not bind to target coupled via amine chemistry to a CM5 Biacore chip (this usually occurs when the relevant binding site on target is masked or destroyed by the coupling to the chip). In such cases cross-blocking can be determined using a tagged version of the target, for example a N-terminal His-tagged version. In this particular format, an anti-His amino acid sequence would be coupled to the Biacore chip and then the His-tagged target would be passed over the surface of the chip and captured by the anti-His amino acid sequence. The cross blocking analysis would be carried out essentially as described above, except that after each chip regeneration cycle, new His-tagged target would be loaded back onto the anti-His amino acid sequence coated surface. In addition to the example given using N-terminal His-tagged target, C-terminal His-tagged target could alternatively be used. Furthermore, various other tags and tag binding protein combinations that are known in the art could be used for such a cross-blocking analysis (e.g. HA tag with anti-HA antibodies; FLAG tag with anti-FLAG antibodies; biotin tag with streptavidin).

The following generally describes an ELISA assay for determining whether an amino acid sequence or other binding agent directed against a target cross-blocks or is capable of cross-blocking as defined herein. It will be appreciated that the assay can be used with any of the amino acid sequences (or other binding agents such as polypeptides of the invention) described herein. The general principal of the assay is to have an amino acid sequence or binding agent that is directed against the target coated onto the wells of an ELISA plate. An excess amount of a second, potentially cross-blocking, anti-target amino acid sequence is added in solution (i.e. not bound to the ELISA plate). A limited amount of the target is then added to the wells. The coated amino acid sequence and the amino acid sequence in solution compete for binding of the limited number of target molecules. The plate is washed to remove excess target that has not been bound by the coated amino acid sequence and to also remove the second, solution phase amino acid sequence as well as any complexes formed between the second, solution phase amino acid sequence and target. The amount of bound target is then measured using a reagent that is appropriate to detect the target. An amino acid sequence in solution that is able to cross-block the coated amino acid sequence will be able to cause a decrease in the number of target molecules that the coated amino acid sequence can bind relative to the number of target molecules that the coated amino acid sequence can bind in the absence of the second, solution phase, amino acid sequence. In the instance where the first amino acid sequence, e.g. an Ab-X, is chosen to be the immobilized amino acid sequence, it is coated onto the wells of the ELISA plate, after which the plates are blocked with a suitable blocking solution to minimize non-specific binding of reagents that are subsequently added. An excess amount of the second amino acid sequence, i.e. Ab-Y, is then added to the ELISA plate such that the moles of Ab-Y target binding sites per well are at least 10 fold higher than the moles of Ab-X target binding sites that were used, per well, during the coating of the ELISA plate. Target is then added such that the moles of target added per well are at least 25-fold lower than the moles of Ab-X target binding sites that were used for coating each well. Following a suitable incubation period the ELISA plate is washed and a reagent for detecting the target is added to measure the amount of target specifically bound by the coated anti[target amino acid sequence (in this case Ab-X). The background signal for the assay is defined as the signal obtained in wells with the coated amino acid sequence (in this case Ab-X), second solution phase amino acid sequence (in this case Ab-Y), target buffer only (i.e. without target) and target detection reagents. The positive control signal for the assay is defined as the signal obtained in wells with the coated amino acid sequence (in this case Ab-X), second solution phase amino acid sequence buffer only (i.e. without second solution phase amino acid sequence), target and target detection reagents. The ELISA assay may be run in such a manner so as to have the positive control signal be at least 6 times the background signal. To avoid any artifacts (e.g. significantly different affinities between Ab-X and Ab-Y for the target) resulting from the choice of which amino acid sequence to use as the coating amino acid sequence and which to use as the second (competitor) amino acid sequence, the cross-blocking assay may to be run in two formats: 1) format 1 is where Ab-X is the amino acid sequence that is coated onto the ELISA plate and Ab-Y is the competitor amino acid sequence that is in solution and 2) format 2 is where Ab-Y is the amino acid sequence that is coated onto the ELISA plate and Ab-X is the competitor amino acid sequence that is in solution. Ab-X and Ab-Y are defined as cross-blocking if, either in format 1 or in format 2, the solution phase anti-target amino acid sequence is able to cause a reduction of between 60% and 100%, specifically between 70% and 100%, and more specifically between 80% and 100%, of the target detection signal {i.e. the amount of target bound by the coated amino acid sequence) as compared to the target detection signal obtained in the absence of the solution phase anti-target amino acid sequence (i.e. the positive control wells).

t) An amino acid sequence is said to be "cross-reactive" for two different antigens or antigenic determinants (such as serum albumin from two different species of mammal, such as human serum albumin and cyno serum albumin) if it is specific for (as defined herein) both these different antigens or antigenic determinants.

u) By binding that is "essentially independent of the pH" is generally meant herein that the association constant ($K_A$) of the amino acid sequence with respect to the serum protein (such as serum albumin) at the pH value(s) that occur in a cell of an animal or human body (as further described herein) is at least 5%, such as at least 10%, preferably at least 25%, more preferably at least 50%, even more preferably at least 60%, such as even more preferably at least 70%, such as at least 80% or 90% or more (or even more than 100%, such as more than 110%, more than 120% or even 130% or more, or even more than 150%, or even more than 200%) of the association constant ($K_A$) of the amino acid sequence with respect to the same serum protein at the pH value(s) that occur outside said cell. Alternatively, by binding that is "essentially independent of the pH" is generally meant herein that the $k_{off}$ rate (measured by Biacore) of the amino acid sequence with respect to the serum protein (such as serum albumin) at the pH value(s) that occur in a cell of an animal or human body (as e.g. further described herein, e.g. pH around 5.5, e.g. 5.3 to 5.7) is at least 5%, such as at least 10%, preferably at least 25%, more preferably at least 50%, even more preferably at least 60%, such as even more preferably at least 70%, such as at least 80% or 90% or more (or even more than 100%, such as more than 110%, more than 120% or even 130% or more, or even more than 150%, or even more than 200%) of the $k_{off}$ rate of the amino acid sequence with respect to the same serum protein at the pH value(s) that occur outside said cell, e.g. pH 7.2 to 7.4. By "the pH value(s) that occur in a cell of an animal or human body" is meant the pH value(s) that may occur inside a cell, and in particular inside a cell that is involved in the recycling of the serum protein. In particular, by "the pH value(s) that occur in a cell of an animal or human body" is meant the pH value(s) that may occur inside a (sub)cellular compartment or vesicle that is involved in recycling of the serum protein (e.g. as a result of pinocytosis, endocytosis, transcytosis, exocytosis and phagocytosis or a similar mechanism of uptake or internalization into said cell), such as an endosome, lysosome or pinosome.

v) As further described herein, the total number of amino acid residues in a Nanobody can be in the region of 110-120, is preferably 112-115, and is most preferably 113. It should however be noted that parts, fragments, analogs or derivatives (as further described herein) of a Nanobody are not particularly limited as to their length and/or size, as long as such parts, fragments, analogs or derivatives meet the further requirements outlined herein and are also preferably suitable for the purposes described herein;

w) As further described in paragraph q) on pages 58 and 59 of WO 08/020,079 (incorporated herein by reference), the amino acid residues of a Nanobody are numbered according to the general numbering for $V_H$ domains given by Kabat et al. ("Sequence of proteins of immunological interest", US Public Health Services, NIH Bethesda, Md., Publication No. 91), as applied to $V_{HH}$ domains from Camelids in the article of Riechmann and Muyldermans, J. Immunol. Methods 2000 Jun. 23; 240 (1-2): 185-195 (see for example FIG. 2 of this publication), and accordingly FR1 of a Nanobody comprises the amino acid residues at positions 1-30, CDR1 of a Nanobody comprises the amino acid residues at positions 31-35, FR2 of a Nanobody comprises the amino acids at positions 36-49, CDR2 of a Nanobody comprises the amino acid residues at positions 50-65, FR3 of a Nanobody comprises the amino acid residues at positions 66-94, CDR3 of a Nanobody comprises the amino acid residues at positions 95-102, and FR4 of a Nanobody comprises the amino acid residues at positions 103-113.

x) The Figures, Sequence Listing and the Experimental Part/Examples are only given to further illustrate the invention and should not be interpreted or construed as limiting the scope of the invention and/or of the appended claims in any way, unless explicitly indicated otherwise herein.

The present invention provides amino acid sequences and polypeptides (also referred to as "polypeptides of the invention") that are capable of binding to two or more different antigenic determinants, epitopes, parts, domains of IL-6R. In this context, the amino acid sequences and polypeptides of the invention are also referred to as "multiparatopic" (such as e.g. "biparatopic" or "triparatopic", etc.) amino acid sequences and polypeptides. The multiparatopic amino acid sequences and polypeptides of the invention can be directed against any antigenic determinants, epitopes, parts, and/or domains of IL-6R. For example, and generally, a biparatopic polypeptide of the invention may comprise at least one amino acid sequence and/or Nanobody directed against a first antigenic determinant, epitope, part or domain of IL-6R and at least one amino acid sequence and/or Nanobody directed against a second antigenic determinant, epitope, part or domain of IL-6R different from the first antigenic determinant, epitope, part or domain (in which said amino acid sequences and/or Nanobody may be suitably linked, for example via a suitable linker as further described herein). Preferably, such a biparatopic polypeptide of the invention is further such that, when it binds to IL-6R, it is capable of simultaneously binding to the first antigenic determinant, epitope, part or domain (i.e. via the at least one amino acid sequence and/or Nanobody of the invention capable of binding to said first antigenic determinant, epitope, part or domain) and binding to said second antigenic determinant, epitope, part or domain (i.e. via the at least one amino acid sequence and/or Nanobody of the invention capable of binding to said second antigenic determinant, epitope, part or domain). Examples of such biparatopic polypeptides of the invention will become clear from the further description herein. Also, a triparatopic polypeptide of the invention may comprise at least one further amino acid sequence and/or Nanobody of the invention directed against a third antigenic determinant, epitope, part or domain of IL-6R (different from both the first and second antigenic determinant, epitope, part or domain), and generally multiparatopic polypeptides of the invention may contain at least two amino acid sequences and/or Nanobodies of the invention directed against at least two different antigenic determinants, epitopes, parts or domains of IL-6R. Generally, such biparatopic, triparatopic and multiparatopic polypeptides of the invention may be as further described herein, and the various preferred aspects of the invention as described herein also apply to these biparatopic, triparatopic and multiparatopic polypeptides of the invention (for example, these biparatopic, triparatopic and multiparatopic polypeptides of the invention preferably comprise single variable domains and more preferably Nanobodies).

Preferably, the epitopes bound by the amino acid sequences and/or Nanobodies comprised in the biparatopic (or multiparatopic) polypeptides of the invention are extracellular epitopes. Some specific epitopes to which the amino acid sequences and/or Nanobodies and polypeptides of the invention may preferably bind will become clear from the further description herein.

In a preferred, but non-limiting aspect, the biparatopic (or multiparatopic) polypeptides of the invention are directed against an epitope that lies in, forms part of, or overlaps with (i.e. in the primary or tertiary structure) or is in close proximity to (i.e. in the primary or tertiary structure) the IL-6 binding site on IL-6R (for example, competitively with IL-6) and/or are capable of competing with IL-6 for binding to IL-6R, as well as against at least one other antigenic determinant, epitope, part or domain on ft-6R. Generally, such a biparatopic (or multiparatopic) polypeptide of the invention will contain at least one amino acid sequence and/or Nanobody that is capable of binding an epitope that lies in, forms part of, or overlaps with (i.e. in the primary or tertiary structure) or is in close proximity to (i.e. in the primary or tertiary structure) the IL-6 binding site on IL-6R (for example, competitively with IL-6), and/or capable of competing with IL-6 for binding to IL-6R, as well as at least one further amino acid sequence and/or Nanobody that is capable of binding to at least one other antigenic determinant, epitope, part or domain on IL-6R. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the IL-6 binding site and the at least one other antigenic determinant, epitope, part or domain on IL-6R; and preferably comprise single variable domains and more preferably Nanobodies).

In another preferred, but non-limiting aspect, the biparatopic (or multiparatopic) polypeptides of the invention are directed against one or more of the 18 contact residues as described in Boulanger et al. 2003 (Science 300: 2101-2104) present in the extracellular D3 domain of the IL-6R, more preferably amino acid residues Phe229 and Phe279 present in the extracellular D3 domain of the IL-6R), as well as against at least one other antigenic determinant, epitope, part or domain on IL-6R. Generally, such a biparatopic (or multiparatopic) polypeptide of the invention will contain at least one amino acid sequence and/or Nanobody that is capable of binding one or more of the 18 contact residues as described in Boulanger et al. 2003 (Science 300: 2101-2104) present in the extracellular D3 domain of the IL-6R, more preferably amino acid residues Phe229 and Phe279 present in the extracellular D3 domain of the IL-6R), as well as at least one further amino acid sequence and/or Nanobody that is capable of binding to at least one other antigenic determinant, epitope, part or domain on IL-6R. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the one or more of the 18 contact residues as described in Boulanger et al. 2003 (Science 300: 2101-2104) present in the extracellular D3 domain of the IL-6R, more preferably amino acid residues Phe229 and Phe279 present in the extracellular D3 domain of the IL-6R) and the at least one other antigenic determinant, epitope, part or domain on IL-6R; and preferably comprise single variable domains and more preferably Nanobodies).

In another preferred, but non-limiting aspect, the biparatopic (or multiparatopic) polypeptides of the invention are directed against amino acid residues Phe229 and Phe279 present in the extracellular D3 domain of the IL-6R, as well as against at least one other antigenic determinant, epitope, part or domain on IL-6R. Generally, such a biparatopic (or multiparatopic) polypeptide of the invention will contain at least one amino acid sequence and/or Nanobody that is capable of binding amino acid residues Phe229 and Phe279 present in the extracellular D3 domain of the IL-6R, as well as at least one further amino acid sequence and/or Nanobody that is capable of binding to at least one other antigenic determinant, epitope, part or domain on IL-6R. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the amino acid residues Phe229 and Phe279 present in the extracellular D3 domain of the IL-6R and the at least one other antigenic determinant, epitope, part or domain on IL-6R; and preferably comprise single variable domains and more preferably Nanobodies).

In another preferred, but non-limiting aspect, the biparatopic (or multiparatopic) polypeptides of the invention are at least capable, upon binding to IL-6R, (i) to modulate, and in particular inhibit and/or prevent, binding of IL-6R to IL-6 and/or binding of the IL-6/IL-6R complex to gp130 and thus (ii) to modulate, and in particular inhibit or prevent, the signalling that is mediated by IL-6, IL-6R, IL-6/IL-BR complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways.

Such biparatopic (or multiparatopic) polypeptides of the invention preferably comprise at least one amino acid sequence and/or Nanobody that is capable, upon binding to IL-6R, (i) to modulate, and in particular inhibit and/or prevent, binding of IL-6R to IL-6 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways; as well as at least one further amino acid sequence and/or Nanobody that is capable of binding to at least one other antigenic determinant, epitope, part or domain on IL-6R (i.e. different from the antigenic determinant, epitope, part or domain to which the aforementioned amino acid sequence and/or Nanobody can bind). Such biparatopic (or multiparatopic) polypeptides of the invention preferably comprise at least one amino acid sequence and/or Nanobody that is directed against an epitope that lies in, forms part of, or overlaps with (i.e. in the primary or tertiary structure) or is in close proximity to (i.e. in the primary or tertiary structure) to the IL-6 binding site on IL-6R (preferably, one or more of the 18 contact residues as described in Boulanger et al. 2003 (Science 300: 2101-2104) present in the extracellular D3 domain of the IL-6R, more preferably amino acid residues Phe229 and Phe279 present in the extracellular D3 domain of the IL-6R; for example, competitively with IL-6) and/or are capable of competing with IL-6 for binding to IL-6R, as well as at least one further amino acid sequence and/or Nanobody that is capable of binding to at least one other antigenic determinant, epitope, part or domain on IL-6R. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the IL-6 binding site and the at least one other antigenic determinant, epitope, part or domain on IL-6R; and preferably comprise single variable domains and more preferably Nanobodies).

In another preferred, but non-limiting aspect, the biparatopic (or multiparatopic) polypeptides of the invention are directed against an epitope that lies in, forms part of, or overlaps with (i.e. in the primary or tertiary structure) or is in close proximity to (i.e. in the primary or tertiary structure) the gp130 binding site on IL-6R and/or the IL-6/IL-6R complex (for example, competitively with gp130); and/or are capable of competing with gp130 for binding to IL-6R and/or the IL-6/IL-6R complex, as well as against at least one other antigenic determinant, epitope, part or domain on IL-6R. Generally, such a biparatopic (or multiparatopic) polypeptide of the invention will contain at least one amino acid sequence and/or Nanobody that is capable of binding an epitope that lies in, forms part of, or overlaps with (i.e. in the primary or tertiary structure) or is in close proximity to (i.e. in the primary or tertiary structure) the gp130 binding site on IL-6R and/or the IL-6/IL-6R complex (for example, competitively with gp130), and/or that is capable of competing with gp130 for binding to the IL-6/IL-6R complex, as well as at least one further amino acid sequence and/or Nanobody that is capable of binding to at least one other antigenic determinant, epitope, part or domain on IL-6R. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the gp130 binding site on IL-6R and/or the IL-6/IL-6R complex and the at least one other antigenic determinant, epitope, part or domain on IL-6R; and preferably comprise single variable domains and more preferably Nanobodies).

In another preferred, but non-limiting aspect, the biparatopic (or multiparatopic) polypeptides of the invention are at least capable, upon binding to IL-6R, (i) to modulate, and in particular inhibit and/or prevent, binding of the IL-6/IL-6R complex to gp130 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways.

Such biparatopic (or multiparatopic) polypeptides of the invention preferably comprise at least one amino acid sequence and/or Nanobody that is capable, upon binding to IL-6R, (i) to modulate, and in particular inhibit and/or prevent, binding of the IL-6/IL-6R complex to gp130 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways; as well as at least one further amino acid sequence and/or Nanobody that is capable of binding to at least one other antigenic determinant, epitope, part or domain on IL-6R (i.e. different from the antigenic determinant, epitope, part or domain to which the aforementioned amino acid sequence and/or Nanobody of the invention can bind). Such biparatopic (or multiparatopic) polypeptides of the invention preferably comprise at least one amino acid sequence and/or that is directed against an epitope that lies in, forms part of, or overlaps with (i.e. in the primary or tertiary structure) or is in close proximity to (i.e. in the primary or tertiary structure) to the gp130 binding site on IL-6R and/or the IL-6/Il-6R complex (for example, competitively with gp130) and/or are capable of competing with gp130 for binding the IL-6/IL-6R complex, as well as at least one further amino acid sequence and/or Nanobody that is capable of binding to at least one other antigenic determinant, epitope, part or domain on IL-6R. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the gp130 binding site on IL-6R and/or the IL-6/IL-6R complex and the at least one other antigenic determinant, epitope, part or domain on IL-6R; and preferably comprise single variable domains and more preferably Nanobodies).

In a preferred, but non-limiting aspect, the biparatopic (or multiparatopic) polypeptides of the invention are directed against an epitope that lies in, forms part of, or overlaps with (i.e. in the primary or tertiary structure) or is in close proximity to (i.e. in the primary or tertiary structure) the binding site of the reference IgG (as defined by SEQ. ID NO's: 126 and 127) and/or the reference Fab (as defined by SEQ ID NO's: 128 and 129) on IL-6R (for example, competitively with the reference IgG and/or the reference Fab) and/or are capable of competing with the reference IgG and/or the reference Fab for binding to IL-6R, as well as against at least one other antigenic determinant, epitope, part or domain on IL-6R. Generally, such a biparatopic (or multiparatopic) polypeptide of the invention will contain at least one amino acid sequence and/or Nanobody that is capable of binding an epitope that lies in, forms part of, or overlaps with (i.e. in the primary or tertiary structure) or is in close proximity to (i.e. in the primary or tertiary structure) the binding site of the reference IgG and/or the reference Fab on IL-6R (for example, competitively with the reference IgG and/or the reference Fab), and/or capable of competing with the reference IgG and/or the reference Fab for binding to IL-6R, as well as at least one further amino acid sequence and/or Nanobody that is capable of binding to at least one other antigenic determinant, epitope, part or domain on IL-6R. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the binding site of the reference IgG and/or the reference Fab on and the at least one other antigenic determinant, epitope, part or domain on IL-6R; and preferably comprise single variable domains and more preferably Nanobodies).

In another preferred, but non-limiting aspect, the biparatopic (or multiparatopic) polypeptides of the invention are at least capable, upon binding to IL-6R, (i) to modulate, and in particular inhibit and/or prevent, binding of IL-6R to IL-6 and/or binding of the IL-6/IL-6R complex to gp130 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways, or more generally capable of modulating (as defined herein) IL-6R or IL-6R mediated signalling via the same mechanism of action as the reference IgG and/or the reference Fab.

Such biparatopic (or multiparatopic) polypeptides of the invention preferably comprise at least one amino acid sequence and/or Nanobody that is capable, upon binding to IL-6R, (i) to modulate, and in particular inhibit and/or prevent, binding of IL-6R to IL-6 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways, or more generally capable of modulating (as defined herein) IL-6R or IL-6R mediated signalling via the same mechanism of action as the reference IgG and/or the reference Fab; as well as at least one further amino acid sequence and/or Nanobody that is capable of binding to at least one other antigenic determinant, epitope, part or domain on IL-6R (i.e. different from the antigenic determinant, epitope, part or domain to which the aforementioned amino acid sequence and/or Nanobody can bind). Such biparatopic (or multiparatopic) polypeptides of the invention preferably comprise at least one amino acid sequence and/or Nanobody that is directed against an epitope that lies in, forms part of, or overlaps with (i.e. in the primary or tertiary structure) or is in close proximity to (i.e. in the primary or tertiary structure) to the binding site of the reference IgG and/or the reference Fab on IL-6R (for example, competitively with the reference IgG and/or the reference Fab) and/or are capable of competing with the reference IgG and/or the reference Fab for binding to IL-6R, as well as at least one further amino acid sequence and/or Nanobody that is capable of binding to at least one other antigenic determinant, epitope, part or domain on IL-6R. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the binding site of the reference IgG and/or the reference Fab on IL-6R and the at least one other antigenic determinant, epitope, part or domain on IL-6R; and preferably comprise single variable domains and more preferably Nano bodies).

In a preferred, but non-limiting aspect, the biparatopic (or multiparatopic) polypeptides of the invention are directed against an epitope that lies in, forms part of, or overlaps with (i.e. in the primary or tertiary structure) or is in close proximity to (i.e. in the primary or tertiary structure) the Tocilizumab (MRA) binding site on IL-6R (for example, competitively with Tocilizumab (MRA)) and/or are capable of competing with Tocilizumab (MRA) for binding to IL-6R, as well as against at least one other antigenic determinant, epitope, part or domain on IL-6R. Generally, such a biparatopic (or multiparatopic) polypeptide of the invention will contain at least one amino acid sequence and/or Nanobody that is capable of binding an epitope that lies in, forms part of, or overlaps with (i.e. in the primary or tertiary structure) or is in close proximity to (i.e. in the primary or tertiary structure) the Tocilizumab (MRA) binding site on IL-6R (for example, competitively with Tocilizumab (MRA)), and/or capable of competing with Tocilizumab (MRA) for binding to IL-6R, as well as at least one further amino acid sequence and/or Nanobody that is capable of binding to at least one other antigenic determinant, epitope, part or domain on IL-6R. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the Tocilizumab (MRA) binding on IL-6R and the at least one other antigenic determinant, epitope, part or domain on IL-6R; and preferably comprise single variable domains and more preferably Nanobodies).

In another preferred, but non-limiting aspect, the biparatopic (or multiparatopic) polypeptides of the invention are at least capable, upon binding to IL-6R, (i) to modulate, and in particular inhibit and/or prevent, binding of IL-6R to IL-6 and/or binding of the IL-6/IL-6R complex to gp130 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL-6/IL-6R complex and/or gp130 are involved, and/or (iv) to modulate the biological mechanisms, responses and effects associated with such signalling or these pathways, or more generally capable of modulating (as defined herein) IL-6R or IL-6R mediated signalling via the same mechanism of action as Tocilizumab (MRA).

Such biparatopic (or multiparatopic) polypeptides of the invention preferably comprise at least one amino acid sequence and/or Nanobody that is capable, upon binding to IL-6R, (i) to modulate, and in particular inhibit and/or prevent, binding of IL-6R to IL-6 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways, or more generally capable of modulating (as defined herein) IL-6R or IL-6R mediated signalling via the same mechanism of action as Tocilizumab (MRA); as well as at least one further amino acid sequence and/or Nanobody that is capable of binding to at least one other antigenic determinant, epitope, part or domain on IL-6R (i.e. different from the antigenic determinant, epitope, part or domain to which the aforementioned amino acid sequence and/or Nanobody can bind). Such biparatopic (or multi-paratopic) polypeptides of the invention preferably comprise at least one amino acid sequence and/or Nanobody that is directed against an epitope that lies in, forms part of, or overlaps with (i.e. in the primary or tertiary structure) or is in close proximity to (i.e. in the primary or tertiary structure) to the Tocilizumab (MRA) binding site on IL-6R (for example, competitively with Tocilizumab (MRA)) and/or are capable of competing with Tocilizumab (MRA) for binding to IL-6R, as well as at least one further amino acid sequence and/or Nanobody that is capable of binding to at least one other antigenic determinant, epitope, part or domain on IL-6R. Generally, such biparatopic (or multi-paratopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the Tocilizumab (MRA) binding site on IL-6R and the at least one other antigenic determinant, epitope, part or domain on IL-6R; and preferably comprise single variable domains and more preferably Nanobodies).

In a preferred, but non-limiting aspect, the biparatopic (or multiparatopic) polypeptides of the invention are directed against an epitope that lies in, forms part of, or overlaps with (i.e. in the primary or tertiary structure) or is in close proximity to (i.e. in the primary or tertiary structure) the M182 binding site on IL-6R (for example, competitively with M182) and/or are capable of competing with M182 for binding to IL-6R, as well as against at least one other antigenic determinant, epitope, part or domain on IL-6R. Generally, such a biparatopic (or multiparatopic) polypeptide of the invention will contain at least one amino acid sequence and/or Nanobody that is capable of binding an epitope that lies in, forms part of, or overlaps with (i.e. in the primary or tertiary structure) or is in close proximity to (i.e. in the primary or tertiary structure) the M182 binding site on IL-6R (for example, competitively with M182), and/or capable of competing with M182 for binding to IL-6R, as well as at least one further amino acid sequence and/or Nanobody that is capable of binding to at least one other antigenic determinant, epitope, part or domain on IL-6R. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the M182 binding site on IL-6R and the at least one other antigenic determinant, epitope, part or domain on IL-6R; and preferably comprise single variable domains and more preferably Nanobodies).

In another preferred, but non-limiting aspect, the amino acid sequences and (in particular) polypeptides of the invention are biparatopic (or multiparatopic) and are at least capable, upon binding to IL-6R, (i) to modulate, and in particular inhibit and/or prevent, binding of the IL-6/IL-6R complex to gp130 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways, or more generally capable of modulating (as defined herein) IL-6R or IL-6R mediated signalling via the same mechanism of action as M182.

Such biparatopic (or multiparatopic) polypeptides of the invention preferably comprise at least one amino acid sequence and/or Nanobody that is capable, upon binding to IL-6R, (i) to modulate, and in particular inhibit and/or prevent, binding of the IL-6/IL-6R complex to gp130 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways, or more generally capable of modulating (as defined herein) IL-6R or IL-6R mediated signalling via the same mechanism of action as M182; as well as at least one further amino acid sequence and/or Nanobody that is capable of binding to at least one other antigenic determinant, epitope, part or domain on IL-6R (i.e. different from the antigenic determinant, epitope, part or domain to which the aforementioned amino acid sequence and/or Nanobody can bind). Such biparatopic (or multiparatopic) polypeptides of the invention preferably comprise at least one amino acid sequence and/or Nanobody that is directed against an epitope that lies in, forms part of, or overlaps with (i.e. in the primary or tertiary structure) or is in close proximity to (i.e. in the primary or tertiary structure) to the M182 binding site on IL-6R (for example, competitively with M182) and/or are capable of competing with M182 for binding to IL-6R, as well as at least one further amino acid sequence and/or Nanobody that is capable of binding to at least one other antigenic determinant, epitope, part or domain on IL-6R. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the M182 binding site on IL-6R and the at least one other antigenic determinant, epitope, part or domain on IL-6R; and preferably comprise single variable domains and more preferably Nanobodies).

In a preferred, but non-limiting aspect, the biparatopic (or multiparatopic) polypeptides of the invention are directed against an epitope that lies in, forms part of, or overlaps with (i.e. in the primary or tertiary structure) or is in close proximity to (i.e. in the primary or tertiary structure) the BN-12 binding site on IL-6R (for example, competitively with BN-12) and/or are capable of competing with BN-12 for binding to IL-6R, as well as against at least one other antigenic determinant, epitope, part or domain on IL-6R. Generally, such a biparatopic (or multiparatopic) polypeptide of the invention will contain at least one amino acid sequence and/or Nanobody that is capable of binding an epitope that lies in, forms part of, or overlaps with (i.e. in the primary or tertiary structure) or is in close proximity to (i.e. in the primary or tertiary structure) the BN-12 binding site on IL-6R (for example, competitively with M182), and/or capable of competing with BN-12 for binding to IL-6R, as well as at least one further amino acid sequence and/or Nanobody that is capable of binding to at least one other antigenic determinant, epitope, part or domain on IL-6R. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the BN-12 binding site on IL-6R and the at least one other antigenic determinant, epitope, part or domain on IL-6R; and preferably comprise single variable domains and more preferably Nanobodies).

In another preferred, but non-limiting aspect, the biparatopic (or multiparatopic) polypeptides of the invention are at least capable, upon binding to IL-6R, (i) to modulate, and in particular inhibit and/or prevent binding of IL-6R to IL-6 and/or binding of the IL-6/IL-6R complex to gp130 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways.

Such biparatopic (or multiparatopic) polypeptides of the invention preferably comprise at least one amino acid sequence and/or Nanobody that is capable, upon binding to IL-6R, (i) to modulate, and in particular inhibit and/or prevent binding of IL-6R to IL-6 and/or binding of the IL-6/IL-6R complex to gp130 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways; as well as at least one further amino acid sequence and/or Nanobody that is capable of binding to at least one other antigenic determinant, epitope, part or domain on IL-6R (i.e. different from the antigenic determinant, epitope, part or domain to which the aforementioned amino acid sequence and/or Nanobody can bind). Such biparatopic (or multiparatopic) polypeptides of the invention preferably comprise at least one amino acid sequence and/or Nanobody that is directed against an epitope that lies in, forms part of, or overlaps with (i.e. in the primary or tertiary structure) or is in close proximity to (i.e. in the primary or tertiary structure) to the BN-12 binding site on IL-6R (for example, competitively with BN-12) and/or is capable of competing with BN-12 for binding to IL-6R, as well as at least one further amino acid sequence and/or Nanobody that is capable of binding to at least one other antigenic determinant, epitope, part or domain on IL-6R. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the BN-12 binding site on IL-6R and the at least one other antigenic determinant, epitope, part or domain on IL-6R; and preferably comprise single variable domains and more preferably Nanobodies).

The at least one further amino acid sequence and/or Nanobody that is capable of binding to at least one other antigenic determinant, epitope, part or domain on IL-6R may be any amino acid sequence and/or Nanobody that is directed against and/or capable of binding IL-6R.

In a preferred but non-limiting aspect, the at least one further amino acid sequence and/or Nanobody that is capable of binding to at least one other antigenic determinant or epitope, part or domain on IL-6R binds an eptiope present in the extracellular D1 domain; and/or said at least one further amino acid sequence and/or Nanobody will recognize and/or specifically bind IL-6R while not binding the hybrid IL-6R (as described in Example 3; SEQ ID NO: 131). Accordingly, in a preferred but non-limiting aspect, the biparatopic (or multiparatopic) polypeptides of the invention may also be directed against an epitope that lies in, forms part of, or overlaps with (i.e. in the primary or tertiary structure) or is in close proximity to (i.e. in the primary or tertiary structure) the D1 domain of IL-6R and/or may be capable of specifically binding IL-6R while not binding the hybrid IL-6R (as described in Example 3; SEQ ID NO: 131).

In another preferred but non-limiting aspect, the at least one further amino acid sequence and/or Nanobody that is capable of binding to at least one other antigenic determinant, epitope, part or domain on IL-6R binds an eptiope present in the extracellular D2 domain; and/or said at least one further amino acid sequence and/or Nanobody will recognize and/or specifically bind IL-6R as well as the hybrid IL-6R (as described in Example 3; SEQ ID NO: 131). Accordingly, in a preferred but non-limiting aspect, the biparatopic (or multiparatopic) polypeptides of the invention may also be directed against an epitope that lies in, forms part of, or overlaps with (i.e. in the primary or tertiary structure) or is in close proximity to (i.e. in the primary or tertiary structure) the D2 domain of IL-6R and/or may be capable of specifically binding IL-6R as well as the hybrid IL-6R (as described in Example 3; SEQ ID NO: 131), In another preferred but non-limiting aspect, the at least one further amino acid sequence and/or Nanobody that is capable of binding to at least one other antigenic determinant, epitope, part or domain on IL-6R binds an eptiope present in the extracellular D3 domain; and/or said at least one further amino acid sequence and/or Nanobody will recognize and/or specifically bind IL-6R as well as the hybrid IL-6R (as described in Example 3; SEQ ID NO: 131). Accordingly, in a preferred but non-limiting aspect, the biparatopic (or multiparatopic) polypeptides of the invention may also be directed against an epitope that lies in, forms part of, or overlaps with (i.e. in the primary or tertiary structure) or is in close proximity to (i.e. in the primary or tertiary structure) the D3 domain of IL-6R and/or may be capable of specifically binding IL-6R as well as the hybrid IL-6R (as described in Example 3; SEQ ID NO: 131).

Accordingly, in another preferred, but non-limiting aspect, the biparatopic (or multiparatopic) polypeptides of the invention may be directed against an epitope that lies in, forms part of, or overlaps with (i.e. in the primary or tertiary structure) or is in close proximity to (i.e. in the primary or tertiary structure) the IL-6 binding site on IL-6R ((preferably, one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R; for example, competitively with IL-6) and/or are capable of competing with IL-6 for binding to IL-6R, as well as against at least one other antigenic determinant or epitope on IL-6R that lies in, forms part of, or overlaps with (i.e. in the primary or tertiary structure) or is in close proximity to (i.e. in the primary or tertiary structure) the D1 domain of IL-6R; and/or may be capable of specifically binding IL-6R while not binding the hybrid IL-6R (as described in Example 3; SEQ ID NO: 131). Generally, such a biparatopic (or multiparatopic) polypeptide of the invention will contain at least one amino acid sequence and/or Nanobody that is capable of binding an epitope that lies in, forms part of, or overlaps with (i.e. in the primary or tertiary structure) or is in close proximity to (i.e. in the primary or tertiary structure) the IL-6 binding site on IL-6R ((preferably, one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the 1'-6R; for example, competitively with IL-6), and/or capable of competing with IL-6 for binding to IL-6R, as well as at least one further amino acid sequence and/or Nanobody that is capable of binding to at least one other antigenic determinant or epitope on IL-6R that lies in, forms part of, or overlaps with (i.e. in the primary or tertiary structure) or is in close proximity to (i.e. in the primary or tertiary structure) the D1 domain of IL-6R and/or may be capable of specifically binding IL-6R while not binding the hybrid IL-6R (as described in Example 3; SEQ ID NO: 131). Generally, such biparatopic for multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the IL-6 binding site and the at least one other antigenic determinant or epitope in the D1 domain on IL-6R; and preferably comprise single variable domains and more preferably Nanobodies).

Accordingly, in another preferred, but non-limiting aspect, the biparatopic (or multiparatopic) polypeptides of the invention may be directed against an epitope that lies in, forms part of, or overlaps with (i.e. in the primary or tertiary structure) or is in close proximity to (i.e. in the primary or tertiary structure) the IL-6 binding site on IL-6R ((preferably, one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R; for example, competitively with IL-6) and/or are capable of competing with IL-6 for binding to IL-6R, as well as against at least one other antigenic determinant or epitope on IL-6R that lies in, forms part of, or overlaps with (i.e. in the primary or tertiary structure) or is in close proximity to (i.e. in the primary or tertiary structure) the D2 domain of IL-6R; and/or may be capable of specifically binding IL-6R as well as the hybrid IL-6R (as described in Example 3; SEQ ID NO: 131). Generally, such a biparatopic (or multiparatopic) polypeptide of the invention will contain at least one amino acid sequence and/or Nanobody that is capable of binding an epitope that lies in, forms part of, or overlaps with (i.e. in the primary or tertiary structure) or is in close proximity to (i.e. in the primary or tertiary structure) the IL-6 binding site on IL-6R ((preferably, one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R; for example, competitively with IL-6), and/or capable of competing with IL-6 for binding to IL-6R, as well as at least one further amino acid sequence and/or Nanobody that is capable of binding to at least one other antigenic determinant or epitope on IL-6R that lies in, forms part of, or overlaps with (i.e. in the primary or tertiary structure) or is in close proximity to (i.e. in the primary or tertiary structure) the D2 domain of IL-6R and/or may be capable of specifically binding IL-6R as well as the hybrid IL-6R (as described in Example 3; SEQ ID NO: 131). Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the IL-6 binding site and the at least one other antigenic determinant or epitope in the D2 domain on IL-6R; and preferably comprise single variable domains and more preferably Nanobodies).

Accordingly, in another preferred, but non-limiting aspect, the biparatopic (or multiparatopic) polypeptides of the invention may be directed against an epitope that lies in, forms part of, or overlaps with (i.e. in the primary or tertiary structure) or is in close proximity to (i.e. in the primary or tertiary structure) the IL-6 binding site on IL-6R ((preferably, one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R; for example, competitively with IL-6) and/or are capable of competing with IL-6 for binding to IL-6R, as well as against at least one other antigenic determinant or epitope on IL-6R that lies in, forms part of, or overlaps with (i.e. in the primary or tertiary structure) or is in close proximity to (i.e. in the primary or tertiary structure) the D3 domain of IL-6R; and/or may be capable of specifically binding IL-6R as well as the hybrid IL-6R (as described in Example 3; SEQ ID NO: 131). Generally, such a biparatopic (or multiparatopic) polypeptide of the invention will contain at least one amino acid sequence and/or Nanobody that is capable of binding an epitope that lies in, forms part of, or overlaps with (i.e. in the primary or tertiary structure) or is in close proximity to (i.e. in the primary or tertiary structure) the IL-6 binding site on IL-6R ((preferably, one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R; for example, competitively with IL-6), and/or capable of competing with IL-6 for binding to IL-6R, as well as at least one further amino acid sequence and/or Nanobody that is capable of binding to at least one other antigenic determinant or epitope on IL-6R that lies in, forms part of, or overlaps with (i.e. in the primary or tertiary structure) or is in close proximity to (i.e. in the primary or tertiary structure) the D3 domain of IL-6R and/or may be capable of specifically binding IL-6R as well as the hybrid IL-6R (as described in Example 3; SEQ ID NO: 131). Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the IL-6 binding site and the at least one other antigenic determinant or epitope in the D3 domain on IL-6R; and preferably comprise single variable domains and more preferably Nanobodies).

In another preferred, but non-limiting aspect, the biparatopic (or multiparatopic) polypeptides of the invention are directed against an epitope that lies in, forms part of, or overlaps with (i.e. in the primary or tertiary structure) or is in close proximity to (i.e. in the primary or tertiary structure) the gp130 binding site on IL-6R and/or the IL-6/IL-6R complex (for example, competitively with gp130); and/or are capable of competing with gp130 for binding to IL-6R and/or the IL-6/IL-6R complex, as well as against at least one other antigenic determinant or epitope on IL-6R that lies in, forms part of, or overlaps with (i.e. in the primary or tertiary structure) or is in close proximity to (i.e. in the primary or tertiary structure) the D1 domain of IL-6R; and/or may be capable of specifically binding IL-6R while not binding the hybrid IL-6R (as described in Example 3; SEQ ID NO: 131). Generally, such a biparatopic (or multiparatopic) polypeptide of the invention will contain at least one amino acid sequence and/or Nanobody that is capable of binding an epitope that lies in, forms part of, or overlaps with (i.e. in the primary or tertiary structure) or is in close proximity to (i.e. in the primary or tertiary structure) the gp130 binding site on IL-6R and/or the IL-6/IL-6R complex (for example, competitively with gp130), and/or that is capable of competing with gp130 for binding to IL-6R and/or the IL-6/IL-6R complex, as well as at least one further amino acid sequence and/or Nanobody that is capable of binding to at least one other antigenic determinant or epitope on IL-6R that lies in, forms part of, or overlaps with (i.e. in the primary or tertiary structure) or is in close proximity to (i.e. in the primary or tertiary structure) the D1 domain of IL-6R; and/or may be capable of specifically binding IL-6R while not binding the hybrid IL-6R (as described in Example 3; SEQ ID NO: 131). Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the gp130 binding site on IL-6R and/or the IL-6/IL-6R complex and the at least one other antigenic determinant or epitope in the D1 domain on IL-6R; and preferably comprise single variable domains and more preferably Nanobodies).

In another preferred, but non-limiting aspect, the biparatopic (or multiparatopic) polypeptides of the invention are directed against an epitope that lies in, forms part of, or overlaps with (i.e. in the primary or tertiary structure) or is in close proximity to (i.e. in the primary or tertiary structure) the gp130 binding site on IL-6R and/or the IL-6/IL-6R complex (for example, competitively with gp130); and/or are capable of competing with gp130 for binding to IL-6R and/or the IL-6/IL-6R complex, as well as against at least one other antigenic determinant or epitope on IL-6R that lies in, forms part of, or overlaps with (i.e. in the primary or tertiary structure) or is in close proximity to (i.e. in the primary or tertiary structure) the D2 domain of IL-6R; and/or may be capable of specifically binding IL-6R as well as the hybrid IL-6R (as described in Example 3; SEQ ID NO: 131). Generally, such a biparatopic (or multiparatopic) polypeptide of the invention will contain at least one amino acid sequence and/or Nanobody that is capable of binding an epitope that lies in, forms part of, or overlaps with (i.e. in the primary or tertiary structure) or is in close proximity to (i.e. in the primary or tertiary structure) the gp130 binding site on IL-6R and/or the IL-6/IL-6R complex (for example, competitively with gp130), and/or that is capable of competing with gp130 for binding to IL-6R and/or the IL-6/IL-6R complex, as well as at least one further amino acid sequence and/or Nanobody that is capable of binding to at least one other antigenic determinant or epitope on IL-6R that lies in, forms part of, or overlaps with (i.e. in the primary or tertiary structure) or is in close proximity to (i.e. in the primary or tertiary structure) the D2 domain of IL-6R; and/or may be capable of specifically binding IL-6R as well as the hybrid IL-6R (as described in Example 3; SEQ ID NO: 131). Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the gp130 binding site on IL-6R and/or the IL-6/IL-6R complex and the at least one other antigenic determinant or epitope in the D2 domain on IL-6R; and preferably comprise single variable domains and more preferably Nanobodies).

In another preferred, but non-limiting aspect, the biparatopic (or multiparatopic) polypeptides of the invention are directed against an epitope that lies in, forms part of, or overlaps with (i.e. in the primary or tertiary structure) or is in close proximity to (i.e. in the primary or tertiary structure) the gp130 binding site on IL-6R and/or the IL-6/IL-6R complex (for example, competitively with gp130); and/or are capable of competing with gp130 for binding to IL-6R and/or the IL-6/IL-6R complex, as well as against at least one other antigenic determinant or epitope on IL-6R that lies in, forms part of, or overlaps with (i.e. in the primary or tertiary structure) or is in close proximity to (i.e. in the primary or tertiary structure) the D3 domain of IL-6R; and/or may be capable of specifically binding IL-6R as well as the hybrid IL-6R (as described in Example 3; SEQ ID NO: 131). Generally, such a biparatopic (or multiparatopic) polypeptide of the invention will contain at least one amino acid sequence and/or Nanobody that is capable of binding an epitope that lies in, forms part of, or overlaps with (i.e. in the primary or tertiary structure) or is in close proximity to (i.e. in the primary or tertiary structure) the gp130 binding site on IL-6R and/or the IL-6/IL-6R complex (for example, competitively with gp130), and/or that is capable of competing with gp130 for binding to IL-6R and/or the IL-6/IL-6R complex, as well as at least one further amino acid sequence and/or Nanobody that is capable of binding to at least one other antigenic determinant or epitope on IL-6R that lies in, forms part of, or overlaps with (i.e. in the primary or tertiary structure) or is in close proximity to (i.e. in the primary or tertiary structure) the D3 domain of IL-6R; and/or may be capable of specifically binding IL-6R as well as the hybrid IL-6R (as described in Example 3; SEQ ID NO: 131). Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the gp130 binding site on IL-6R and/or the IL-6/IL-6R complex and the at least one other antigenic determinant or epitope in the D3 domain on IL-6R; and preferably comprise single variable domains and more preferably Nanobodies).

In a preferred, but non-limiting aspect, the biparatopic (or multiparatopic) polypeptides of the invention are directed against an epitope that lies in, forms part of, or overlaps with (i.e. in the primary or tertiary structure) or is in close proximity to (i.e. in the primary or tertiary structure) the binding site of the reference IgG (as defined by SEQ ID NO's: 126 and 127) and/or the reference Fab (as defined by SEQ ID NO's: 128 and 129) on IL-6R (for example, competitively with the reference IgG and/or the reference Fab) and/or are capable of competing with the reference IgG and/or the reference Fab for binding to IL-6R, as well as against at least one other antigenic determinant or epitope on IL-6R that lies in, forms part of, or overlaps with (i.e. in the primary or tertiary structure) or is in close proximity to (i.e. in the primary or tertiary structure) the D1 domain of IL-6R; and/or may be capable of specifically binding IL-6R while not binding the hybrid IL-6R (as described in Example 3; SEQ ID NO: 131). Generally, such a biparatopic (or multiparatopic) polypeptide of the invention will contain at least one amino acid sequence and/or Nanobody that is capable of binding an epitope that lies in, forms part of, or overlaps with (i.e. in the primary or tertiary structure) or is in close proximity to (i.e. in the primary or tertiary structure) the binding site of the reference IgG and/or the reference Fab on IL-6R (for example, competitively with the reference IgG and/or the reference Fab), and/or capable of competing with the reference IgG and/or the reference Fab for binding to IL-6R, as well as at least one further amino acid sequence and/or Nanobody that is capable of binding to at least one other antigenic determinant or epitope on IL-6R that lies in, forms part of, or overlaps with (i.e. in the primary or tertiary structure) or is in close proximity to (i.e. in the primary or tertiary structure) the D1 domain of IL-6R; and/or may be capable of specifically binding IL-6R while not binding the hybrid IL-6R (as described in Example 3; SEQ ID NO: 131). Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the binding site of the reference IgG and/or the reference Fab on IL-6R and the at least one other antigenic determinant or epitope in the D1 domain on IL-6R; and preferably comprise single variable domains and more preferably Nanobodies).

In a preferred, but non-limiting aspect, the biparatopic (or multiparatopic) polypeptides of the invention are directed against an epitope that lies in, forms part of, or overlaps with (i.e. in the primary or tertiary structure) or is in close proximity to (i.e. in the primary or tertiary structure) the binding site of the reference IgG (as defined by SEQ ID NO's: 126 and 127) and/or the reference Fab (as defined by SEQ ID NO's: 128 and 129) on IL-6R (for example, competitively with the reference IgG and/or the reference Fab) and/or are capable of competing with the reference IgG and/or the reference Fab for binding to IL-6R, as well as against at least one other antigenic determinant or epitope on IL-6R that lies in, forms part of, or overlaps with (i.e. in the primary or tertiary structure) or is in close proximity to (i.e. in the primary or tertiary structure) the D2 domain of IL-6R; and/or may be capable of specifically binding IL-6R as will as the hybrid IL-6R (as described in Example 3; SEQ ID NO: 131). Generally, such a biparatopic (or multiparatopic) polypeptide of the invention will contain at least one amino acid sequence and/or Nanobody that is capable of binding an epitope that lies in, forms part of, or overlaps with (i.e. in the primary or tertiary structure) or is in close proximity to (i.e. in the primary or tertiary structure) the binding site of the reference IgG and/or the reference Fab on IL-6R (for example, competitively with the reference IgG and/or the reference Fab), and/or capable of competing with the reference IgG and/or the reference Fab for binding to IL-6R, as well as at least one further amino acid sequence and/or Nanobody that is capable of binding to at least one other antigenic determinant or epitope on IL-6R that lies in, forms part of, or overlaps with (i.e. in the primary or tertiary structure) or is in close proximity to (i.e. in the primary or tertiary structure) the D2 domain of IL-6R; and/or may be capable of specifically binding IL-6R as well as the hybrid IL-6R (as described in Example 3; SEQ ID NO: 131). Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the binding site of the reference IgG and/or the reference Fab on IL-6R and the at least one other antigenic determinant or epitope in the D2 domain on IL-6R; and preferably comprise single variable domains and more preferably Nanobodies).

In a preferred, but non-limiting aspect, the biparatopic (or multiparatopic) polypeptides of the invention are directed against an epitope that lies in, forms part of, or overlaps with (i.e. in the primary or tertiary structure) or is in close proximity to (i.e. in the primary or tertiary structure) the binding site of the reference IgG (as defined by SEQ ID NO's: 126 and 127) and/or the reference Fab (as defined by SEQ ID NO's: 128 and 129) on IL-6R (for example, competitively with the reference IgG and/or the reference Fab) and/or are capable of competing with the reference IgG and/or the reference Fab for binding to IL-6R, as well as against at least one other antigenic determinant or epitope on IL-6R that lies in, forms part of, or overlaps with (i.e. in the primary or tertiary structure) or is in close proximity to (i.e. in the primary or tertiary structure) the D3 domain of IL-6R; and/or may be capable of specifically binding IL-6R as well as the hybrid IL-6R (as described in Example 3; SEQ ID NO: 131). Generally, such a biparatopic (or multiparatopic) polypeptide of the invention will contain at least one amino acid sequence and/or Nanobody that is capable of binding an epitope that lies in, forms part of, or overlaps with (i.e. in the primary or tertiary structure) or is in close proximity to (i.e. in the primary or tertiary structure) the binding site of the reference IgG and/or the reference Fab on IL-6R (for example, competitively with the reference IgG and/or the reference Fab), and/or capable of competing with the reference IgG and/or the reference Fab for binding to IL-6R, as well as at least one further amino acid sequence and/or Nanobody that is capable of binding to at least one other antigenic determinant or epitope on IL-6R that lies in, forms part of, or overlaps with (i.e. in the primary or tertiary structure) or is in close proximity to (i.e. in the primary or tertiary structure) the D3 domain of IL-6R; and/or may be capable of specifically binding IL-6R as well as the hybrid IL-6R (as described in Example 3; SEQ ID NO: 131). Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the binding site of the reference IgG and/or the reference Fab on IL-6R and the at least one other antigenic determinant or epitope in the D3 domain on IL-6R; and preferably comprise single variable domains and more preferably Nano bodies).

In a preferred, but non-limiting aspect, the biparatopic (or multiparatopic) polypeptides of the invention are directed against an epitope that lies in, forms part of, or overlaps with (i.e. in the primary or tertiary structure) or is in close proximity to (i.e. in the primary or tertiary structure) the Tocilizumab (MRA) binding site on IL-6R (for example, competitively with Tocilizumab (MRA)) and/or are capable of competing with Tocilizumab (MRA) for binding to IL-6R, as well as against at least one other antigenic determinant or epitope on IL-6R that lies in, forms part of, or overlaps with (i.e. in the primary or tertiary structure) or is in close proximity to (i.e. in the primary or tertiary structure) the D1 domain of IL-6R; and/or may be capable of specifically binding IL-6R while not binding the hybrid IL-6R (as described in Example 3; SEQ ID NO: 131). Generally, such a biparatopic (or multiparatopic) polypeptide of the invention will contain at least one amino acid sequence and/or Nanobody that is capable of binding an epitope that lies in, forms part of, or overlaps with (i.e. in the primary or tertiary structure) or is in close proximity to (i.e. in the primary or tertiary structure) the Tocilizumab (MRA) binding site on IL-6R (for example, competitively with Tocilizumab (MRA)), and/or capable of competing with Tocilizumab (MRA) for binding to IL-6R, as well as at least one other antigenic determinant or epitope on IL-6R that lies in, forms part of, or overlaps with (i.e. in the primary or tertiary structure) or is in close proximity to (i.e. in the primary or tertiary structure) the D1 domain of IL-6R; and/or may be capable of specifically binding IL-6R while not binding the hybrid IL-6R (as described in Example 3; SEQ ID NO: 131). Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the Tocilizumab (MRA) binding on IL-6R and the at least one other antigenic determinant or epitope in the D1 domain on IL-6R; and preferably comprise single variable domains and more preferably Nanobodies).

In a preferred, but non-limiting aspect, the biparatopic (or multiparatopic) polypeptides of the invention are directed against an epitope that lies in, forms part of, or overlaps with (i.e. in the primary or tertiary structure) or is in close proximity to (i.e. in the primary or tertiary structure) the Tocilizumab (MRA) binding site on IL-6R (for example, competitively with Tocilizumab (MRA)) and/or are capable of competing with Tocilizumab (MRA) for binding to IL-6R, as well as against at least one other antigenic determinant or epitope on IL-6R that lies in, forms part of, or overlaps with (i.e. in the primary or tertiary structure) or is in close proximity to (i.e. in the primary or tertiary structure) the D2 domain of IL-6R; and/or may be capable of specifically binding IL-6R as well as the hybrid IL-6R (as described in Example 3; SEQ ID NO: 131). Generally, such a biparatopic (or multiparatopic) polypeptide of the invention will contain at least one amino acid sequence and/or Nanobody that is capable of binding an epitope that lies in,
forms part of, or overlaps with (i.e. in the primary or tertiary structure) or is in close proximity to (i.e. in the primary or tertiary structure) the Tocilizumab (MRA) binding site on IL-6R (for example, competitively with Tocilizumab (MRA)), and/or capable of competing with Tocilizumab (MRA) for binding to IL-6R, as well as at least one other antigenic determinant or epitope on IL-6R that lies in, forms part of, or overlaps with (i.e. in the primary or tertiary structure) or is in close proximity to (i.e. in the primary or tertiary structure) the D2 domain of IL-6R; and/or may be capable of specifically binding IL-6R as well as the hybrid IL-6R (as described in Example 3; SEQ ID NO: 131). Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the Tocilizumab (MRA) binding on IL-6R and the at least one other antigenic determinant or epitope in the D2 domain on IL-6R; and preferably comprise single variable domains and more preferably Nanobodies).

In a preferred, but non-limiting aspect, the biparatopic (or multiparatopic) polypeptides of the invention are directed against an epitope that lies in, forms part of, or overlaps with (i.e. in the primary or tertiary structure) or is in close proximity to (i.e. in the primary or tertiary structure) the Tocilizumab (MRA) binding site on IL-6R (for example, competitively with Tocilizumab (MRA)) and/or are capable of competing with Tocilizumab (MRA) for binding to IL-6R, as well as against at least one other antigenic determinant or epitope on IL-6R that lies in, forms part of, or overlaps with (i.e. in the primary or tertiary structure) or is in close proximity to (i.e. in the primary or tertiary structure) the D3 domain of IL-6R; and/or may be capable of specifically binding IL-6R as well as the hybrid IL-6R (as described in Example 3; SEQ ID NO: 131). Generally, such a biparatopic (or multiparatopic) polypeptide of the invention will contain at least one amino acid sequence and/or Nanobody that is capable of binding an epitope that lies in, forms part of, or overlaps with (i.e. in the primary or tertiary structure) or is in close proximity to (i.e. in the primary or tertiary structure) the Tocilizumab (MRA) binding site on IL-6R (for example, competitively with Tocilizumab (MRA)), and/or capable of competing with Tocilizumab (MRA) for binding to IL-6R, as well as at least one other antigenic determinant or epitope on IL-6R that lies in, forms part of, or overlaps with (i.e. in the primary or tertiary structure) or is in close proximity to (i.e. in the primary or tertiary structure) the D3 domain of IL-6R; and/or may be capable of specifically binding IL-6R as well as the hybrid IL-6R (as described in Example 3; SEQ ID NO: 131). Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the Tocilizumab (MRA) binding on IL-6R and the at least one other antigenic determinant or epitope in the D3 domain on IL-6R; and preferably comprise single variable domains and more preferably Nanobodies).

In a preferred, but non-limiting aspect, the biparatopic (or multiparatopic) polypeptides of the invention are directed against an epitope that lies in, forms part of, or overlaps with (i.e. in the primary or tertiary structure) or is in close proximity to (i.e. in the primary or tertiary structure) the M182 binding site on IL-6R (for example, competitively with M182) and/or are capable of competing with M182 for binding to IL-6R, as well as against at least one other antigenic determinant or epitope on IL-6R that lies in, forms part of, or overlaps with (i.e. in the primary or tertiary structure) or is in close proximity to (i.e. in the primary or tertiary structure) the D1 domain of IL-6R; and/or may be capable of specifically binding IL-6R while not binding the hybrid IL-6R (as described in Example 3; SEQ ID NO: 131). Generally, such a biparatopic (or multiparatopic) polypeptide of the invention will contain at least one amino acid sequence and/or Nanobody that is capable of binding an epitope that lies in, forms part of, or overlaps with (i.e. in the primary or tertiary structure) or is in close proximity to (i.e. in the primary or tertiary structure) the M182 binding site on IL-6R (for example, competitively with M182), and/or capable of competing with M182 for binding to IL-6R, as well as at least one further amino acid sequence and/or Nanobody that is capable of binding to at least one other antigenic determinant or epitope on IL-6R that lies in, forms part of, or overlaps with (i.e. in the primary or tertiary structure) or is in close proximity to (i.e. in the primary or tertiary structure) the D1 domain of IL-6R; and/or may be capable of specifically binding IL-6R while not binding the hybrid IL-6R (as described in Example 3; SEQ ID NO: 131). Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the M182 binding site on IL-6R and the at least one other antigenic determinant or epitope in the D1 domain on IL-6R; and preferably comprise single variable domains and more preferably Nanobodies).

In a preferred, but non-limiting aspect, the biparatopic (or multiparatopic) polypeptides of the invention are directed against an epitope that lies in, forms part of, or overlaps with (i.e. in the primary or tertiary structure) or is in close proximity to (i.e. in the primary or tertiary structure) the M182 binding site on IL-6R (for example, competitively with M182) and/or are capable of competing with M182 for binding to IL-6R, as well as against at least one other antigenic determinant or epitope on IL-6R that lies in, forms part of, or overlaps with (i.e. in the primary or tertiary structure) or is in close proximity to (i.e. in the primary or tertiary structure) the D2 domain of IL-6R; and/or may be capable of specifically binding IL-6R as well as the hybrid IL-6R (as described in Example 3; SEQ ID NO: 131). Generally, such a biparatopic (or multiparatopic) polypeptide of the invention will contain at least one amino acid sequence and/or Nanobody that is capable of binding an epitope that lies in, forms part of, or overlaps with (i.e. in the primary or tertiary structure) or is in close proximity to (i.e. in the primary or tertiary structure) the M182 binding site on IL-6R (for example, competitively with M182), and/or capable of competing with M182 for binding to IL-6R, as well as at least one further amino acid sequence and/or Nanobody that is capable of binding to at least one other antigenic determinant or epitope on IL-6R that lies in, forms part of, or overlaps with (i.e. in the primary or tertiary structure) or is in close proximity to (i.e. in the primary or tertiary structure) the D2 domain of IL-6R; and/or may be capable of specifically binding IL-6R as well as the hybrid IL-6R (as described in Example 3; SEQ ID NO: 131). Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the M182 binding site on IL-6R and the at least one other antigenic determinant or epitope in the D2 domain on IL-6R; and preferably comprise single variable domains and more preferably Nanobodies).

In a preferred, but non-limiting aspect, the biparatopic (or multiparatopic) polypeptides of the invention are directed against an epitope that lies in, forms part of, or overlaps with (i.e. in the primary or tertiary structure) or is in close proximity to (i.e. in the primary or tertiary structure) the M182 binding site on IL-6R (for example, competitively with M182) and/or are capable of competing with M182 for binding to IL-6R, as well as against at least one other antigenic determinant or epitope on IL-6R that lies in, farms part of, or overlaps with (i.e. in the primary or tertiary structure) or is in close proximity to (i.e. in the primary or tertiary structure) the D3 domain of IL-6R; and/or may be capable of specifically binding IL-6R as well as the hybrid IL-6R (as described in Example 3; SEQ ID NO: 131). Generally, such a biparatopic (or multiparatopic) polypeptide of the invention will contain at least one amino acid sequence and/or Nanobody that is capable of binding an epitope that lies in, forms part of, or overlaps with (i.e. in the primary or tertiary structure) or is in close proximity to (i.e. in the primary or tertiary structure) the M182 binding site on IL-6R (for example, competitively with M182), and/or capable of competing with M182 for binding to IL-6R, as well as at least one further amino acid sequence and/or Nanobody that is capable of binding to at least one other antigenic determinant or epitope on IL-6R that lies in, forms part of, or overlaps with (i.e. in the primary or tertiary structure) or is in close proximity to (i.e. in the primary or tertiary structure) the D3 domain of IL-6R; and/or may be capable of specifically binding IL-6R as well as the hybrid IL-6R (as described in Example 3; SEQ ID NO: 131). Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the M182 binding site on IL-6R and the at least one other antigenic determinant or epitope in the D3 domain on IL-6R; and preferably comprise single variable domains and more preferably Nanobodies).

In a preferred, but non-limiting aspect, the biparatopic (or multiparatopic) polypeptides of the invention are directed against an epitope that lies in, forms part of, or overlaps with (i.e. in the primary or tertiary structure) or is in close proximity to (i.e. in the primary or tertiary structure) the BN-12 binding site on IL-6R (for example, competitively with BN-12) and/or are capable of competing with BN-12 for binding to IL-6R, as well as against at least one other antigenic determinant or epitope on IL-6R that lies in, forms part of, or overlaps with (i.e. in the primary or tertiary structure) or is in close proximity to (i.e. in the primary or tertiary structure) the D1 domain of IL-6R; and/or may be capable of specifically binding IL-6R while not binding the hybrid IL-6R (as described in Example 3; SEQ ID NO: 131).

Generally, such a biparatopic (or multiparatopic) polypeptide of the invention will contain at least one amino acid sequence and/or Nanobody that is capable of binding an epitope that lies in, forms part of, or overlaps with (i.e. in the primary or tertiary structure) or is in close proximity to (i.e. in the primary or tertiary structure) the BN-12 binding site on IL-6R (for example, competitively with M182), and/or capable of competing with BN-12 for binding to IL-6R, as well as at least one further amino acid sequence and/or Nanobody that is capable of binding to at least one other antigenic determinant or epitope on IL-6R that lies in, forms part of, or overlaps with (i.e. in the primary or tertiary structure) or is in close proximity to (i.e. in the primary or tertiary structure) the D1 domain of IL-6R; and/or may be capable of specifically binding IL-6R while not binding the hybrid IL-6R (as described in Example 3; SEQ ID NO: 131). Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the BN-12 binding site on IL-6R and the at least one other antigenic determinant or epitope in the D1 domain on IL-6R; and preferably comprise single variable domains and more preferably Nanobodies).

In a preferred, but non-limiting aspect, the biparatopic (or multiparatopic) polypeptides of the invention are directed against an epitope that lies in, forms part of, or overlaps with (i.e. in the primary or tertiary structure) or is in close proximity to (i.e. in the primary or tertiary structure) the BN-12 binding site on IL-6R (for example, competitively with BN-12) and/or are capable of competing with BN-12 for binding to IL-6R, as well as against at least one other antigenic determinant or epitope on IL-6R that lies in, forms part of, or overlaps with (i.e. in the primary or tertiary structure) or is in close proximity to (i.e. in the primary or tertiary structure) the D2 domain of IL-6R; and/or may be capable of specifically binding IL-6R as well as the hybrid IL-6R (as described in Example 3; SEQ ID NO: 131). Generally, such a biparatopic (or multiparatopic) polypeptide of the invention will contain at least one amino acid sequence and/or Nanobody that is capable of binding an epitope that lies in, forms part of, or overlaps with (i.e. in the primary or tertiary structure) or is in close proximity to (i.e. in the primary or tertiary structure) the BN-12 binding site on IL-6R (for example, competitively with M182), and/or capable of competing with BN-12 for binding to IL-6R, as well as at least one further amino acid sequence and/or Nanobody that is capable of binding to at least one other antigenic determinant or epitope on IL-6R that lies in, forms part of, or overlaps with (i.e. in the primary or tertiary structure) or is in close proximity to (i.e. in the primary or tertiary structure) the D2 domain of IL-6R; and/or may be capable of specifically binding IL-6R as well as the hybrid IL-6R (as described in Example 3; SEQ ID NO: 131). Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the BN-12 binding site on IL-6R and the at least one other antigenic determinant or epitope in the D2 domain on IL-6R; and preferably comprise single variable domains and more preferably Nanobodies).

In a preferred, but non-limiting aspect, the biparatopic (or multiparatopic) polypeptides of the invention are directed against an epitope that lies in, forms part of, or overlaps with (i.e. in the primary or tertiary structure) or is in close proximity to (i.e. in the primary or tertiary structure) the BN-12 binding site on IL-6R (for example, competitively with BN-12) and/or are capable of competing with BN-12 for binding to IL-6R, as well as against at least one other antigenic determinant or epitope on IL-6R that lies in, forms part of, or overlaps with (i.e. in the primary or tertiary structure) or is in close proximity to (i.e. in the primary or tertiary structure) the D3 domain of IL-6R; and/or may be capable of specifically binding IL-6R as well as the hybrid IL-6R (as described in Example 3; SEQ ID NO: 131). Generally, such a biparatopic (or multiparatopic) polypeptide of the invention will contain at least one amino acid sequence and/or Nanobody that is capable of binding an epitope that lies in, forms part of, or overlaps with (i.e. in the primary or tertiary structure) or is in close proximity to (i.e. in the primary or tertiary structure) the BN-12 binding site on IL-6R (for example, competitively with M182), and/or capable of competing with BN-12 for binding to IL-6R, as well as at least one further amino acid sequence and/or Nanobody that is capable of binding to at least one other antigenic determinant or epitope on IL-6R that lies in, forms part of, or overlaps with (i.e. in the primary or tertiary structure) or is in close proximity to (i.e. in the primary or tertiary structure) the D3 domain of IL-6R; and/or may be capable of specifically binding IL-6R as well as the hybrid IL-6R (as described in Example 3; SEQ ID NO: 131). Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the BN-12 binding site on IL-6R and the at least one other antigenic determinant or epitope in the D3 domain on IL-6R; and preferably comprise single variable domains and more preferably Nanobodies).

In another preferred, but non-limiting aspect, the biparatopic (or multiparatopic) polypeptides of the invention have both paratopes directed against an epitope that lies in, forms part of, or overlaps with (i.e. in the primary or tertiary structure) or is in close proximity to (i.e. in the primary or tertiary structure) the IL-6 binding site on IL-6R (preferably, one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R; for example, competitively with IL-6) and/or both capable of competing with IL-6 for binding to IL-6R.

Again, the above biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind both binding sites; and preferably comprise single variable domains and more preferably Nanobodies).

In another preferred, but non-limiting aspect, the biparatopic (or multiparatopic) polypeptides of the invention are at least capable, upon binding to IL-6R, (i) to modulate, and in particular inhibit and/or prevent, binding of IL-6R to IL-6 and/or binding of the IL-6/IL-6R complex to gp130 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways.

Such biparatopic (or multiparatopic) polypeptides of the invention preferably comprise at least two amino acid sequences and/or Nanobodies that are capable, upon binding to IL-6R, (i) to modulate, and in particular inhibit and/or prevent, binding of IL-6R to IL-6 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways. Such biparatopic (or multiparatopic) polypeptides of the invention preferably comprise at least two amino acid sequences and/or Nanobodies that are directed against an epitope that lies in, forms part of, or overlaps with (i.e. in the primary or tertiary structure) or is in close proximity to (i.e. in the primary or tertiary structure) to the IL-6 binding site on IL-6R (preferably, one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R; for example, competitively with IL-6) and/or that are capable of competing with IL-6 for binding to IL-6R. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind both binding sites; and preferably comprise single variable domains and more preferably Nanobodies).

In another preferred, but non-limiting aspect, the biparatopic (or multiparatopic) polypeptides of the invention are directed against one or more of the 18 contact residues as described in Boulanger et al. 2003 (Science 300, 2101-2104) present in the extracellular D3 domain of the IL-6R (more preferably amino acid residues Phe229 and Phe279 present in the extracellular D3 domain of the IL-6R), as well as against another epitope that lies in, forms part of, or overlaps with (i.e. in the primary or tertiary structure) or is in close proximity to (i.e. in the primary or tertiary structure) the IL-6 binding site on IL-6R (for example, competitively with IL-6) and/or capable of competing with IL-6 for binding to IL-6R. Generally, such a biparatopic (or multiparatopic) polypeptide of the invention will contain at least one amino acid sequence and/or Nanobody that is capable of binding to one or more of the 18 contact residues as described in Boulanger et al. 2003 (Science 300, 2101-2104) present in the extracellular D3 domain of the IL-6R (more preferably amino acid residues Phe229 and Phe279 present in the extracellular D3 domain of the IL-6R), as well as at least one further amino acid sequence and/or Nanobody that is capable of binding to at least one other epitope that lies in, forms part of, or overlaps with (i.e. in the primary or tertiary structure) or is in close proximity to (i.e. in the primary or tertiary structure) the IL-6 binding site on IL-6R (for example, competitively with IL-6) and/or that is capable of competing with IL-6 for binding to IL-6R. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the one or more of the 18 contact residues as described in Boulanger et al. 2003 (Science 300, 2101-2104) present in the extracellular D3 domain of the IL-6R (more preferably amino acid residues Phe229 and Phe279 present in the extracellular D3 domain of the IL-6R) and the at least one other epitope that lies in, forms part of, or overlaps with (i.e. in the primary or tertiary structure) or is in close proximity to (i.e. in the primary or tertiary structure) the IL-6 binding site on IL-6R; and preferably comprise single variable domains and more preferably Nanobodies).

In another preferred, but non-limiting aspect, the biparatopic (or multiparatopic) polypeptides of the invention are directed against amino acid residues Phe229 and Phe279 present in the extracellular D3 domain of the IL-6R, as well as against another epitope that lies in, forms part of, or overlaps with (i.e. in the primary or tertiary structure) or is in close proximity to (i.e. in the primary or tertiary structure) the IL-6 binding site on IL-6R (for example, competitively with IL-6) and/or capable of competing with IL-6 for binding to IL-6R. Generally, such a biparatopic (or multiparatopic) polypeptide of the invention will contain at least one amino acid sequence and/or Nanobody that is capable of binding amino acid residues Phe229 and Phe279 present in the extracellular D3 domain of the IL-6R, as well as at least one further amino acid sequence and/or Nanobody that is capable of binding to at least one other epitope that lies in, forms part of, or overlaps with (i.e. in the primary or tertiary structure) or is in close proximity to (i.e. in the primary or tertiary structure) the IL-6 binding site on IL-6R (for example, competitively with IL-6) and/or that is capable of competing with IL-6 for binding to IL-6R. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the amino acid residues Phe229 and Phe279 present in the extracellular D3 domain of the IL-6R and the at least one other epitope that lies in, forms part of, or overlaps with (i.e. in the primary or tertiary structure) or is in close proximity to (i.e. in the primary or tertiary structure) the IL-6 binding site on IL-6R; and preferably comprise single variable domains and more preferably Nanobodies).

In another preferred, but non-limiting aspect, the biparatopic (or multiparatopic) polypeptides of the invention are at least directed against an epitope that lies in, forms part of, or overlaps with (i.e. in the primary or tertiary structure) or is in close proximity to (i.e. in the primary or tertiary structure) the IL-6 binding site on IL-6R (preferably, one or more of the 18 contact residues as described in Boulanger et al. 2003 (Science 300, 2101-2104) present in the extracellular 03 domain of the IL-6R, more preferably amino acid residues Phe229 and Phe279 present in the extracellular D3 domain of the IL-6R; for example, competitively with IL-6) and/or are capable of competing with IL-6 for binding to IL-6R as well as against an epitope that lies in, forms part of, or overlaps with (i.e. in the primary or tertiary structure) or is in close proximity to (i.e. in the primary or tertiary structure) the gp130 binding site on IL-6R and/or the IL-6/IL-6R complex (for example, competitively with gp130) and/or are capable of competing with gp130 for binding to the IL-6/IL-6R complex. Again, the above biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the IL-6 binding site on IL-6R and the gp130 binding site on IL-6R and/or the IL-6/IL-6R complex; and preferably comprise single variable domains and more preferably Nanobodies).

In another preferred, but non-limiting aspect, the biparatopic (or multiparatopic) polypeptides of the invention are at least capable, upon binding to IL-6R, (i) to modulate, and in particular inhibit and/or prevent, binding of IL-6R to IL-6 and/or binding of the IL-6/IL-6R complex to gp130 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways.

Such biparatopic (or multiparatopic) polypeptides of the invention preferably comprise at least one amino acid sequence and/or Nanobody that is capable, upon binding to IL-6R, (i) to modulate, and in particular inhibit and/or prevent, binding of IL-6R to IL-6 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways; as well as at least one further amino acid sequence and/or Nanobody that is capable, upon binding to IL-6R, (i) to modulate, and in particular inhibit and/or prevent, binding of the IL-6/IL-6R complex to gp130 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways. Such biparatopic (or multiparatopic) polypeptides of the invention preferably comprise at least one amino acid sequence of the invention that is directed against an epitope that lies in, forms part of, or overlaps with (i.e. in the primary or tertiary structure) or is in close proximity to (i.e. in the primary or tertiary structure) to the IL-6 binding site on IL-6R (preferably, one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R; for example, competitively with IL-6) and/or are capable of competing with IL-6 for binding to IL-6R, as well as at least one further amino acid sequence of the invention that is directed against an epitope that lies in, forms part of, or overlaps with (i.e. in the primary or tertiary structure) or is in close proximity to (i.e. in the primary or tertiary structure) to the gp130 binding site on IL-6R and/or the IL-6/IL-6R complex (for example, competitively with gp130) and/or that is capable of competing with gp130 for binding to the IL-6/IL-6R complex. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the IL-6 binding site on IL-6R and the gp130 binding site on IL-6R and/or the IL-6/IL-6R complex; and preferably comprise single variable domains and more preferably Nanobodies).

In another preferred, but non-limiting aspect, the biparatopic (or multiparatopic) polypeptides of the invention may have both paratopes directed against an epitope that lies in, forms part of, or overlaps with (i.e. in the primary or tertiary structure) or is in close proximity to (i.e. in the primary or tertiary structure) the gp130 binding site on IL-6R and/or the IL-6/IL-6R complex (for example, competitively with gp130) and/or are both capable of competing with gp130 for binding to the IL-6/IL-6R complex.

Again, the above biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind both binding sites; and preferably comprise single variable domains and more preferably Nanobodies).

In another preferred, but non-limiting aspect, the biparatopic (or multiparatopic) polypeptides of the invention are biparatopic (or multiparatopic) and are at least capable, upon binding to IL-6R, (i) to modulate, and in particular inhibit and/or prevent, binding of the IL-6/IL-6R complex to gp130 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways.

Such biparatopic (or multiparatopic) polypeptides of the invention preferably comprise at least two amino acid sequences and/or Nanobodies that are capable, upon binding to IL-6R, (i) to modulate, and in particular inhibit and/or prevent, binding of the IL-6/IL-6R complex to gp130 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways. Such biparatopic (or multiparatopic) polypeptides of the invention preferably comprise at least two amino acid sequences and/or Nanobodies that are directed against an epitope that lies in, forms part of, or overlaps with (i.e. in the primary or tertiary structure) or is in close proximity to (i.e. in the primary or tertiary structure) to the gp130 binding site on IL-6R and/or the IL-6/IL-6R complex (for example, competitively with gp130) and/or are capable of competing with gp130 for binding to the IL-6/IL-6R complex. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind both binding sites; and preferably comprise single variable domains and more preferably Nanobodies).

In another preferred, but non-limiting aspect, the biparatopic (or multiparatopic) polypeptides of the invention are at least directed against an epitope that lies in, forms part of, or overlaps with (i.e. in the primary or tertiary structure) or is in close proximity to (i.e. in the primary or tertiary structure) the IL-6 binding site on IL-6R (preferably, one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R; for example, competitively with IL-6) and/or are capable of competing with IL-6 for binding to IL-6R as well as against an epitope that lies in, forms part of, or overlaps with (i.e. in the primary or tertiary structure) or is in close proximity to (i.e. in the primary or tertiary structure) the binding site of the reference IgG and/or the reference Fab on IL-6R (for example, competitively with the reference IgG and/or the reference Fab) and/or are capable of competing with the reference IgG and/or the reference Fab for binding to IL-6R. Again, the above biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the IL-6 binding site and the binding site for the reference IgG and/or the reference Fab on IL-6R; and preferably comprise single variable domains and more preferably Nanobodies).

In another preferred, but non-limiting aspect, the biparatopic (or multiparatopic) polypeptides of the invention are at least capable, upon binding to IL-6R, (i) to modulate, and in particular inhibit and/or prevent, binding of IL-6R to IL-6 and/or binding of the IL-6/IL-6R complex to gp130 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways, or more generally capable of modulating (as defined herein) IL-6R or IL-6R mediated signalling via the same mechanism of action as the reference IgG and/or the reference Fab.

Such biparatopic (or multiparatopic) polypeptides of the invention preferably comprise at least one amino acid sequence and/or Nanobody that is capable, upon binding to IL-6R, (i) to modulate, and in particular inhibit and/or prevent, binding of IL-6R to IL-6 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways; as well as at least one further amino acid sequence and/or Nanobody that is capable, upon binding to IL-6R, (i) to modulate, and in particular inhibit and/or prevent, binding of IL-6R to IL-6 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL-6 μL-6R complex and/or gp130 are involved, and/or (iv) to modulate the biological mechanisms, responses and effects associated with such signalling or these pathways, or more generally capable of modulating (as defined herein) IL-6R or IL-6R mediated signalling via the same mechanism of action as the reference IgG and/or the reference Fab. Such biparatopic (or multiparatopic) polypeptides of the invention preferably comprise at least one amino acid sequence and/or Nanobody that is directed against an epitope that lies in, forms part of, or overlaps with (i.e. in the primary or tertiary structure) or is in close proximity to (i.e. in the primary or tertiary structure) to the IL-6 binding site on IL-6R (preferably, one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R; for example, competitively with IL-6) and/or that is capable of competing with IL-6 for binding to IL-6R, as well as at least one further amino acid sequence and/or Nanobody that is directed against an epitope that lies in, forms part of, or overlaps with (i.e. in the primary or tertiary structure) or is in close proximity to (i.e. in the primary or tertiary structure) to the binding site for the reference IgG and/or the reference Fab on IL-6R (for example, competitively with the reference IgG and/or the reference Fab) and/or that is capable of competing with the reference IgG and/or the reference Fab for binding to IL-6R. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the IL-6 binding site and the binding site for the reference IgG and/or the reference Fab on IL-6R; and preferably comprise single variable domains and more preferably Nanobodies).

In another preferred, but non-limiting aspect, the biparatopic (or multiparatopic) polypeptides of the invention are at least directed against an epitope that lies in, forms part of, or overlaps with (i.e. in the primary or tertiary structure) or is in close proximity to (i.e. in the primary or tertiary structure) the binding site for the reference IgG and/or the reference Fab on IL-6R (for example, competitively with IL-6) and/or are capable of competing with the reference IgG and/or the reference Fab for binding to IL-6R as well as against an epitope that lies in, forms part of, or overlaps with (i.e. in the primary or tertiary structure) or is in close proximity to (i.e. in the primary or tertiary structure) the gp130 binding site on IL-6R and/or the IL-6/IL-6R complex (for example, competitively with gp130) and/or are capable of competing with gp130 for binding to the IL-6/IL-6R complex. Again, the above biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the binding site for the reference IgG and/or the reference Fab on IL-6R and the gp130 binding site on IL-6R and/or the IL-6/IL-6R complex; and preferably comprise single variable domains and more preferably Nanobodies).

In another preferred, but non-limiting aspect, the biparatopic (or multiparatopic) polypeptides of the invention are at least capable, upon binding to IL-6R, (i) to modulate, and in particular inhibit and/or prevent, binding of IL-6R to IL-6 and/or binding of the IL-6/IL-6R complex to gp130 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways, or more generally capable of modulating (as defined herein) IL-6R or IL-6R mediated signalling via the same mechanism of action as the reference IgG and/or the reference Fab.

Such biparatopic (or multiparatopic) polypeptides of the invention preferably comprise at least one amino acid sequence and/or Nanobody that is capable, upon binding to IL-6R, (i) to modulate, and in particular inhibit and/or prevent, binding of IL-6R to IL-6 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways, or more generally capable of modulating (as defined herein) IL-6R or IL-6R mediated signalling via the same mechanism of action as the reference IgG and/or the reference Fab; as well as at least one further amino acid sequence and/or Nanobody that is capable, upon binding to IL-6R, (i) to modulate, and in particular inhibit and/or prevent, binding of the IL-6/IL-6R complex to gp130 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways. Such biparatopic (or multiparatopic) polypeptides of the invention preferably comprise at least one amino acid sequence and/or Nanobody that is directed against an epitope that lies in, forms part of, or overlaps with (i.e. in the primary or tertiary structure) or is in close proximity to (i.e. in the primary or tertiary structure) to the binding site for the reference IgG and/or the reference Fab on IL-6R (for example, competitively with IL-6) and/or that is capable of competing with the reference IgG and/or the reference Fab for binding to IL-6R, as well as at least one further amino acid sequence and/or Nanobody that is directed against an epitope that lies in, forms part of, or overlaps with (i.e. in the primary or tertiary structure) or is in close proximity to (i.e. in the primary or tertiary structure) to the gp130 binding site on IL-6R and/or the IL-6/IL-6R complex (for example, competitively with gp130) and/or that is capable of competing with gp130 for binding the IL-6/IL-6R complex. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the binding site for the reference IgG and/or the reference Fab on IL-6R and the gp130 binding site on IL-6R and/or the IL-6/IL-6R complex; and preferably comprise single variable domains and more preferably Nanobodies).

In another preferred, but non-limiting aspect, the biparatopic (or multiparatopic) polypeptides of the invention have both paratopes directed against an epitope that lies in, forms part of, or overlaps with (i.e. in the primary or tertiary structure) or is in close proximity to (i.e. in the primary or tertiary structure) the binding site for the reference IgG and/or the reference Fab on IL-6R (for example, competitively with the reference IgG and/or the reference Fab) and/or are both capable of competing with the reference IgG and/or the reference Fab for binding to IL-6R.

Again, the above biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind both binding sites; and preferably comprise single variable domains and more preferably Nanobodies).

In another preferred, but non-limiting aspect, the biparatopic (or multiparatopic) polypeptides of the invention are at least capable, upon binding to IL-6R, (i) to modulate, and in particular inhibit and/or prevent, binding of IL-6R to IL-6 and/or binding of the IL-6/IL-6R complex to gp130 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways, or more generally capable of modulating (as defined herein) IL-6R or IL-6R mediated signalling via the same mechanism of action as the reference IgG and/or the reference Fab.

Such biparatopic (or multiparatopic) polypeptides of the invention preferably comprise at least two amino acid sequences and/or Nanobodies of that are capable, upon binding to IL-6R, (i) to modulate, and in particular inhibit and/or prevent, binding of IL-6R to IL-6 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways, or more generally capable of modulating (as defined herein) IL-6R or IL-6R mediated signalling via the same mechanism of action as the reference IgG and/or the reference Fab. Such biparatopic (or multiparatopic) polypeptides of the invention preferably comprise at least two amino acid sequences and/or Nanobodies that are directed against an epitope that lies in, forms part of, or overlaps with (i.e. in the primary or tertiary structure) or is in close proximity to (i.e. in the primary or tertiary structure) to the binding site for the reference IgG and/or the reference Fab on IL-6R (for example, competitively with the reference IgG and/or the reference Fab) and/or that are capable of competing with the reference IgG and/or the reference Fab for binding to IL-6R. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind both binding on IL-6R; and preferably comprise single variable domains and more preferably Nanobodies).

In another preferred, but non-limiting aspect, the amino acid sequences and (in particular) biparatopic (or multiparatopic) polypeptides of the invention are at least directed against an epitope that lies in, forms part of, or overlaps with (i.e. in the primary or tertiary structure) or is in close proximity to (i.e. in the primary or tertiary structure) the IL-6 binding site on IL-6R (preferably, one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R; for example, competitively with IL-6) and/or are capable of competing with IL-6 for binding to IL-6R as well as against an epitope that lies in, forms part of, or overlaps with (i.e. in the primary or tertiary structure) or is in close proximity to (i.e. in the primary or tertiary structure) the Tocilizumab (MRA) binding site on IL-6R (for example, competitively with Tocilizumab (MRA)) and/or are capable of competing with Tocilizumab (MRA) for binding to IL-6R. Again, the above biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the IL-6 binding site and the Tocilizumab (MRA) binding site on IL-6R; and preferably comprise single variable domains and more preferably Nanobodies).

In another preferred, but non-limiting aspect, the biparatopic (or multiparatopic) polypeptides of the invention are at least capable, upon binding to IL-6R, (i) to modulate, and in particular inhibit and/or prevent, binding of IL-6R to IL-6 and/or binding of the IL-6/IL-6R complex to gp130 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways, or more generally capable of modulating (as defined herein) IL-6R or IL-6R mediated signalling via the same mechanism of action as Tocilizumab (MRA).

Such biparatopic (or multiparatopic) polypeptides of the invention preferably comprise at least one amino acid sequence and/or Nanobody that is capable, upon binding to IL-6R, (i) to modulate, and in particular inhibit and/or prevent, binding of IL-6R to IL-6 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways; as well as at least one further amino acid sequence and/or Nanobody that is capable, upon binding to IL-6R, (1) to modulate, and in particular inhibit and/or prevent, binding of IL-6R to IL-6 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways, or more generally capable of modulating (as defined herein) IL-6R or IL-6R mediated signalling via the same mechanism of action as Tocilizumab (MRA). Such biparatopic (or multiparatopic) polypeptides of the invention preferably comprise at least one amino acid sequence and/or Nanobody that is directed against an epitope that lies in, forms part of, or overlaps with (i.e. in the primary or tertiary structure) or is in close proximity to (i.e. in the primary or tertiary structure) to the IL-6 binding site on IL-6R (preferably, one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R; for example, competitively with IL-6) and/or are capable of competing with IL-6 for binding to IL-6R, as well as at least one further amino acid sequence and/or Nanobody that is directed against an epitope that lies in, forms part of, or overlaps with (i.e. in the primary or tertiary structure) or is in close proximity to (i.e. in the primary or tertiary structure) to the Tocilizumab (MRA) binding site on IL-6R (for example, competitively with Tocilizumab (MRA)) and/or that is capable of competing with Tocilizumab (MRA) for binding to IL-6R. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the IL-6 binding site and the Tocilizumab (MRA) binding site on IL-6R; and preferably comprise single variable domains and more preferably Nanobodies).

In another preferred, but non-limiting aspect, the biparatopic (or multiparatopic) polypeptides of the invention are at least directed against an epitope that lies in, forms part of, or overlaps with (i.e. in the primary or tertiary structure) or is in close proximity to (i.e. in the primary or tertiary structure) the Tocilizumab (MRA) binding site on IL-6R (for example, competitively with Tocilizumab (MRA)) and/or are capable of competing with Tocilizumab (MRA) for binding to IL-6R as well as against an epitope that lies in, forms part of, or overlaps with (i.e. in the primary or tertiary structure) or is in close proximity to (i.e. in the primary or tertiary structure) the gp130 binding site on IL-6R and/or the IL-6/IL-6R complex (for example, competitively with gp130) and/or are capable of competing with gp130 for binding to the IL-6/IL-6R complex. Again, the above biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the Tocilizumab (MRA) binding site on IL-6R and the gp130 binding site on IL-6R and/or the IL-6/IL-6R complex; and preferably comprise single variable domains and more preferably Nanobodies).

In another preferred, but non-limiting aspect, the biparatopic (or multiparatopic) polypeptides of the invention are at least capable, upon binding to IL-6R, (i) to modulate, and in particular inhibit and/or prevent, binding of IL-6R to IL-6 and/or binding of the IL-6/IL-6R complex to gp130 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways, or more generally capable of modulating (as defined herein) IL-6R or IL-6R mediated signalling via the same mechanism of action as Tocilizumab (MRA).

Such biparatopic (or multiparatopic) polypeptides of the invention preferably comprise at least one amino acid sequence and/or Nanobody that is capable, upon binding to IL-6R, (i) to modulate, and in particular inhibit and/or prevent, binding of IL-6R to IL-6 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways, or more generally capable of modulating (as defined herein) IL-6R or IL-6R mediated signalling via the same mechanism of action as Tocilizumab (MRA); as well as at least one further amino acid sequence and/or Nanobody that is capable, upon binding to IL-6R, (i) to modulate, and in particular inhibit and/or prevent, binding of the IL-6/IL-6R complex to gp130 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways. Such biparatopic (or multiparatopic) polypeptides of the invention preferably comprise at least one amino acid sequence and/or Nanobody that is directed against an epitope that lies in, forms part of, or overlaps with (i.e. in the primary or tertiary structure) or is in close proximity to (i.e. in the primary or tertiary structure) to the Tocilizumab (MRA) binding site on IL-6R (for example, competitively with Tocilizumab (MRA)) and/or that is capable of competing with Tocilizumab (MRA) for binding to IL-6R, as well as at least one further amino acid sequence and/or Nanobody that is directed against an epitope that lies in, forms part of, or overlaps with (i.e. in the primary or tertiary structure) or is in close proximity to (i.e. in the primary or tertiary structure) to the gp130 binding site on IL-6R and/or the IL6/IL-6R complex (for example, competitively with gp130) and/or that is capable of competing with gp130 for binding to the IL6/IL-6R complex. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the Tocilizumab (MRA) binding site on IL-6R and the gp130 binding site on IL-6R and/or the IL6/IL-6R complex; and preferably comprise single variable domains and more preferably Nanobodies).

In another preferred, but non-limiting aspect, the biparatopic (or multiparatopic) polypeptides of the invention are at least directed against an epitope that lies in, forms part of, or overlaps with (i.e. in the primary or tertiary structure) or is in close proximity to (i.e. in the primary or tertiary structure) the binding site for the reference IgG and/or the reference Fab on IL-6R (for example, competitively with the reference IgG and/or the reference Fab) and/or are capable of competing with the reference IgG and/or the reference Fab for binding to IL-6R as well as against an epitope that lies in, forms part of, or overlaps with (i.e. in the primary or tertiary structure) or is in close proximity to (i.e. in the primary or tertiary structure) the Tocilizumab (MRA) binding site on IL-6R (for example, competitively with Tocilizumab (MRA)) and/or are capable of competing with Tocilizumab (MRA) for binding to IL-6R. Again, the above biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the binding site for the reference IgG and/or the reference Fab and the Tocilizumab (MRA) binding site on IL-6R; and preferably comprise single variable domains and more preferably Nanobodies).

In another preferred, but non-limiting aspect, the amino acid sequences and (in particular) polypeptides of the invention are biparatopic (or multiparatopic) and are at least capable, upon binding to IL-6R, (i) to modulate, and in particular inhibit and/or prevent, binding of IL-6R to IL-6 and/or binding of the IL-6/IL-6R complex to gp130 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways, or more generally capable of modulating (as defined herein) IL-6R or IL-6R mediated signalling via the same mechanism of action as Tocilizumab (MRA) and/or the reference IgG and/or the reference Fab.

Such biparatopic (or multiparatopic) polypeptides of the invention preferably comprise at least one amino acid sequence and/or Nanobody that is capable, upon binding to IL-6R, (i) to modulate, and in particular inhibit and/or prevent, binding of IL-6R to IL-6 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL-6/IL-6R complex and/or gp130 are involved, and/or (iv) to modulate the biological mechanisms, responses and effects associated with such signalling or these pathways, or more generally capable of modulating (as defined herein) IL-6R or IL-6R mediated signalling via the same mechanism of action as the reference IgG and/or the reference Fab; as well as at least one further amino acid sequence and/or Nanobody of the invention that is capable, upon binding to IL-6R, (i) to modulate, and in particular inhibit and/or prevent, binding of IL-6R to IL-6 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways, or more generally capable of modulating (as defined herein) IL-6R or IL-6R mediated signalling via the same mechanism of action as Tocilizumab (MRA). Such biparatopic (or multiparatopic) polypeptides of the invention preferably comprise at least one amino acid sequence and/or Nanobody that is directed against an epitope that lies in, forms part of, or overlaps with (i.e. in the primary or tertiary structure) or is in close proximity to (i.e. in the primary or tertiary structure) to the binding site for the reference IgG and/or the reference Fab on IL-6R (for example, competitively with the reference IgG and/or the reference Fab) and/or are capable of competing with the reference IgG and/or the reference Fab for binding to IL-6R, as well as at least one further amino acid sequence and/or Nanobody that is directed against an epitope that lies in, forms part of, or overlaps with (i.e. in the primary or tertiary structure) or is in close proximity to (i.e. in the primary or tertiary structure) to the Tocilizumab (MRA) binding site on IL-6R (for example, competitively with Tocilizumab (MRA)) and/or that is capable of competing with Tocilizumab (MRA) for binding to IL-6R. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the binding site for the reference IgG and/or the reference Fab and the Tocilizumab (MRA) binding site on IL-6R; and preferably comprise single variable domains and more preferably Nanobodies).

In another preferred, but non-limiting aspect, the biparatopic (or multiparatopic) polypeptides of the invention may have both paratopes directed against an epitope that lies in, forms part of, or overlaps with (i.e. in the primary or tertiary structure) or is in close proximity to (i.e. in the primary or tertiary structure) the Tocilizumab (MRA) binding site on IL-6R (for example, competitively with Tocilizumab (MRA)) and/or are both capable of competing with Tocilizumab (MRA) for binding to IL-6R.

Again, the above biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind both binding sites on IL-6R; and preferably comprise single variable domains and more preferably Nanobodies).

In another preferred, but non-limiting aspect, the amino acid sequences and (in particular) polypeptides of the invention are biparatopic (or multiparatopic) and are at least capable, upon binding to IL-6R, (i) to modulate, and in particular inhibit and/or prevent, binding of IL-6R to IL-6 and/or binding of the IL-6/IL-6R complex to gp130 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways, or more generally capable of modulating (as defined herein) IL-6R or IL-6R mediated signalling via the same mechanism of action as Tocilizumab (MRA).

Such biparatopic (or multiparatopic) polypeptides of the invention preferably comprise at least two amino acid sequences and/or Nanobodies that are capable, upon binding to IL-6R, (i) to modulate, and in particular inhibit and/or prevent, binding of IL-6R to IL-6 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways, or more generally capable of modulating (as defined herein) IL-6R or IL-6R mediated signalling via the same mechanism of action as Tocilizumab (MRA). Such biparatopic (or multiparatopic) polypeptides of the invention preferably comprise at least two amino acid sequences and/or Nanobodies that are directed against an epitope that lies in, forms part of, or overlaps with (i.e. in the primary or tertiary structure) or is in close proximity to (i.e. in the primary or tertiary structure) to the Tocilizumab (MRA) binding site on IL-6R (for example, competitively with Tocilizumab (MRA)) and/or that are capable of competing with Tocilizumab (MRA) for binding to IL-6R. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind both binding sites on IL-6R; and preferably comprise single variable domains and more preferably Nanobodies).

In another preferred, but non-limiting aspect, the biparatopic (or multiparatopic) polypeptides of the invention are at least directed against an epitope that lies in, forms part of, or overlaps with (i.e. in the primary or tertiary structure) or is in close proximity to (i.e. in the primary or tertiary structure) the IL-6 binding site on IL-6R (preferably, one or more of the 18 contact residues as described in Boulanger et al. 2003 (Science 300, 2101-2104) present in the extracellular 03 domain of the IL-6R, more preferably amino acid residues Phe229 and Phe279 present in the extracellular D3 domain of the IL-6R; for example, competitively with IL-6) and/or are capable of competing with IL-6 for binding to IL-6R as well as against an epitope that lies in, forms part of, or overlaps with (i.e. in the primary or tertiary structure) or is in close proximity to (i.e. in the primary or tertiary structure) the M182 binding site on IL-6R (for example, competitively with M182) and/or are capable of competing with M182 for binding to IL-6R. Again, the above biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the IL-6 binding site and the M182 binding site on IL-6R; and preferably comprise single variable domains and more preferably Nanobodies).

In another preferred, but non-limiting aspect, the biparatopic (or multiparatopic) polypeptides of the invention are at least capable, upon binding to IL-6R, (i) to modulate, and in particular inhibit and/or prevent, binding of IL-6 to IL-6R and/or binding of the IL-6/IL-6R complex to gp130 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways, or more generally capable of modulating (as defined herein) IL-6R or IL-6R mediated signalling via the same mechanism of action as M182.

Such biparatopic (or multiparatopic) polypeptides of the invention preferably comprise at least one amino acid sequence and/or Nanobody that is capable, upon binding to IL-6R, (i) to modulate, and in particular inhibit and/or prevent, binding of IL-6R to IL-6 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL-6/IL-6R complex and/or gp130 are involved, and/or (iv) to modulate the biological mechanisms, responses and effects associated with such signalling or these pathways; as well as at least one further amino acid sequence and/or Nanobody that is capable, upon binding to IL-6R, (i) to modulate, and in particular inhibit and/or prevent, binding of the IL-6/IL-6R complex to gp130 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways, or more generally capable of modulating (as defined herein) IL-6R or IL-6R mediated signalling via the same mechanism of action as M182. Such biparatopic (or multiparatopic) polypeptides of the invention preferably comprise at least one amino acid sequence and/or Nanobody that is directed against an epitope that lies in, forms part of, or overlaps with (i.e. in the primary or tertiary structure) or is in close proximity to (i.e. in the primary or tertiary structure) to the IL-6 binding site on IL-6R (preferably, one or more of the 18 contact residues as described in Boulanger et al. 2003 (Science 300, 2101-2104) present in the extracellular 03 domain of the IL-6R, more preferably amino acid residues Phe229 and Phe279 present in the extracellular D3 domain of the IL-6R; for example, competitively with IL-6) and/or are capable of competing with IL-6 for binding to IL-6R, as well as at least one further amino acid sequence and/or Nanobody that is directed against an epitope that lies in, forms part of, or overlaps with (i.e. in the primary or tertiary structure) or is in close proximity to (i.e. in the primary or tertiary structure) to the M182 binding site on IL-6R (for example, competitively with M182) and/or that is capable of competing with M182 for binding to IL-6R. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the IL-6 binding site and the M182 binding site on IL-6R; and preferably comprise single variable domains and more preferably Nanobodies).

In another preferred, but non-limiting aspect, the biparatopic (or multiparatopic) polypeptides of the invention are at least directed against an epitope that lies in, forms part of, or overlaps with (i.e. in the primary or tertiary structure) or is in close proximity to (i.e. in the primary or tertiary structure) the M182 binding site on IL-6R (for example, competitively with M182) and/or are capable of competing with M182 for binding to IL-6R as well as against an epitope that lies in, forms part of, or overlaps with (i.e. in the primary or tertiary structure) or is in close proximity to (i.e. in the primary or tertiary structure) the gp130 binding site on IL-6R and/or the IL-6/IL-6R complex (for example, competitively with gp130) and/or are capable of competing with gp130 for binding to the IL-6/1'-6R complex. Again, the above biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the M182 binding site on IL-6R and the gp130 binding site on ft-6R and/or the IL-6/IL-6R complex; and preferably comprise single variable domains and more preferably Nanobodies).

In another preferred, but non-limiting aspect, the biparatopic (or multiparatopic) polypeptides of the invention are at least capable, upon binding to IL-6R, (i) to modulate, and in particular inhibit and/or prevent, binding of the IL-6/IL-6R complex to gp130 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways, or more generally capable of modulating (as defined herein) IL-6R or IL-6R mediated signalling via the same mechanism of action as M182.

Such biparatopic (or multiparatopic) polypeptides of the invention preferably comprise at least one amino acid sequence and/or Nanobody that is capable, upon binding to IL-6R, (i) to modulate, and in particular inhibit and/or prevent, binding of the IL-6/IL-6R complex to gp130 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways, or more generally capable of modulating (as defined herein) IL-6R or IL-6R mediated signalling via the same mechanism of action as M182; as well as at least one further amino acid sequence and/or Nanobody that is capable, upon binding to IL-6R, (i) to modulate, and in particular inhibit and/or prevent, binding of the IL-6/IL-6R complex to gp130 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways. Such biparatopic (or multiparatopic) polypeptides of the invention preferably comprise at least one amino acid sequence and/or Nanobody that is directed against an epitope that lies in, forms part of, or overlaps with (i.e. in the primary or tertiary structure) or is in close proximity to (i.e. in the primary or tertiary structure) to the M182 binding site on IL-6R (for example, competitively with M182) and/or are capable of competing with M182 for binding to IL-6R, as well as at least one further amino acid sequence and/or Nanobody that is directed against an epitope that lies in, forms part of, or overlaps with (i.e. in the primary or tertiary structure) or is in close proximity to (i.e. in the primary or tertiary structure) to the gp130 binding site on IL-6R and/or the IL-6/IL-6R complex (for example, competitively with gp130) and/or that is capable of competing with gp130 for binding to the IL-6/IL-6R complex. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the M182 binding site on IL-6R and the gp130 binding site on IL-6R and/or the IL-6/IL-6R complex; and preferably comprise single variable domains and more preferably Nanobodies).

In another preferred, but non-limiting aspect, the biparatopic (or multiparatopic) polypeptides of the invention are at least directed against an epitope that lies in, forms part of, or overlaps with (i.e. in the primary or tertiary structure) or is in close proximity to (i.e. in the primary or tertiary structure) the binding site for the reference IgG and/or the reference Fab on IL-6R (for example, competitively with the reference IgG and/or the reference Fab) and/or are capable of competing with the reference IgG and/or the reference Fab for binding to IL-6R as well as against an epitope that lies in, forms part of, or overlaps with (i.e. in the primary or tertiary structure) or is in close proximity to (i.e. in the primary or tertiary structure) the M182 binding site on IL-6R (for example, competitively with M182) and/or are capable of competing with M182 for binding to IL-6R. Again, the above biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the binding site for the reference IgG and/or the reference Fab and the M182 binding site on IL-6R; and preferably comprise single variable domains and more preferably Nanobodies).

In another preferred, but non-limiting aspect, the amino acid sequences and (in particular) polypeptides of the invention are biparatopic (or multiparatopic) and are at least capable, upon binding to IL-6R, (i) to modulate, and in particular inhibit and/or prevent, binding of IL-6R to IL-6 and/or binding of the IL-6/IL-6R complex to gp130 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways, or more generally capable of modulating (as defined herein) IL-6R or IL-6R mediated signalling via the same mechanism of action as M182 and/or the reference IgG and/or the reference Fab.

Such biparatopic (or multiparatopic) polypeptides of the invention preferably comprise at least one amino acid sequence and/or Nanobody that is capable, upon binding to IL-6R, (i) to modulate, and in particular inhibit and/or prevent, binding of IL-6R to IL-6 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways, or more generally capable of modulating (as defined herein) IL-6R or IL-6R mediated signalling via the same mechanism of action as the reference IgG and/or the reference Fab; as well as at least one further amino acid sequence and/or Nanobody that is capable, upon binding to IL-6R, (i) to modulate, and in particular inhibit and/or prevent, binding of the IL-6/IL-6R complex to gp130 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways, or more generally capable of modulating (as defined herein) IL-6R or IL-6R mediated signalling via the same mechanism of action as M182. Such biparatopic (or multiparatopic) polypeptides of the invention preferably comprise at least one amino acid sequence and/or Nanobody that is directed against an epitope that lies in, forms part of, or overlaps with (i.e. in the primary or tertiary structure) or is in close proximity to (i.e. in the primary or tertiary structure) to the binding site for the reference IgG and/or the reference Fab on IL-6R (for example, competitively with the reference IgG and/or the reference Fab) and/or that is capable of competing with the reference IgG and/or the reference Fab for binding to IL-6R, as well as at least one further amino acid sequence and/or Nanobody that is directed against an epitope that lies in, forms part of, or overlaps with (i.e. in the primary or tertiary structure) or is in close proximity to (i.e. in the primary or tertiary structure) to the M182 binding site on IL-6R (for example, competitively with M182) and/or that is capable of competing with M182 for binding to IL-6R. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the binding site for the reference IgG and/or the reference Fab and the M182 binding site on IL-6R; and preferably comprise single variable domains and more preferably Nanobodies).

In another preferred, but non-limiting aspect, the biparatopic (or multiparatopic) polypeptides of the invention are at least directed against an epitope that lies in, forms part of, or overlaps with (i.e. in the primary or tertiary structure) or is in close proximity to (i.e. in the primary or tertiary structure) the M182 binding site on IL-6R (for example, competitively with M182) and/or are capable of competing with M182 for binding to IL-6R as well as against an epitope that lies in, forms part of, or overlaps with (i.e. in the primary or tertiary structure) or is in close proximity to (i.e. in the primary or tertiary structure) the Tocilizumab (MRA) binding site on IL-6R (for example, competitively with Tocilizumab (MRA)) and/or are capable of competing with Tocilizumab (MRA) for binding to IL-6R. Again, the above biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the binding site for the M182 and the Tocilizumab (MRA) binding site on IL-6R; and preferably comprise single variable domains and more preferably Nanobodies).

In another preferred, but non-limiting aspect, the amino acid sequences and (in particular) polypeptides of the invention are biparatopic (or multiparatopic) and are at least capable, upon binding to IL-6R, (i) to modulate, and in particular inhibit and/or prevent, binding of IL-6R to IL-6 and/or binding of the IL-6/IL-6R complex to gp130 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways, or more generally capable of modulating (as defined herein) IL-6R or IL-6R mediated signalling via the same mechanism of action as Tocilizumab (MRA) and/or M182.

Such biparatopic (or multiparatopic) polypeptides of the invention preferably comprise at least one amino acid sequence and/or Nanobody that is capable, upon binding to IL-6R, (i) to modulate, and in particular inhibit and/or prevent, binding of the IL-6/IL-6R complex to gp130 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways, or more generally capable of modulating (as defined herein) IL-6R or IL-6R mediated signalling via the same mechanism of action as M182; as well as at least one further amino acid sequence and/or Nanobody that is capable, upon binding to IL-6R, (i) to modulate, and in particular inhibit and/or prevent, binding of IL-6R to IL-6 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways, or more generally capable of modulating (as defined herein) IL-6R or IL-6R mediated signalling via the same mechanism of action as Tocilizumab (MRA). Such biparatopic (or multiparatopic) polypeptides of the invention preferably comprise at least one amino acid sequence and/or Nanobody that is directed against an epitope that lies in, forms part of, or overlaps with (i.e. in the primary or tertiary structure) or is in close proximity to (i.e. in the primary or tertiary structure) to the M182 binding site on IL-6R (for example, competitively with M182) and/or are capable of competing with M182 for binding to IL-6R, as well as at least one further amino acid sequence and/or Nanobody that is directed against an epitope that lies in, forms part of, or overlaps with (i.e. in the primary or tertiary structure) or is in close proximity to (i.e. in the primary or tertiary structure) to the Tocilizumab (MRA) binding site on IL-6R (for example, competitively with Tocilizumab (MRA)) and/or that is capable of competing with Tocilizumab (MRA) for binding to IL-6R. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the M182 binding site and the Tocilizumab (MRA) binding site on IL-6R; and preferably comprise single variable domains and more preferably Nanobodies).

In another preferred, but non-limiting aspect, the biparatopic (or multiparatopic) polypeptides of the invention may have both paratopes directed against an epitope that lies in, forms part of, or overlaps with (i.e. in the primary or tertiary structure) or is in close proximity to (i.e. in the primary or tertiary structure) the M182 binding site on IL-6R (for example, competitively with M182) and/or both capable of competing with M182 for binding to IL-6R.

Again, the above biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind both binding sites on IL-6R; and preferably comprise single variable domains and more preferably Nanobodies).

In another preferred, but non-limiting aspect, the amino acid sequences and (in particular) polypeptides of the invention are biparatopic (or multiparatopic) and are at least capable, upon binding to IL-6R, (i) to modulate, and in particular inhibit and/or prevent, binding of the IL-6/IL-6R complex to gp130 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways, or more generally capable of modulating (as defined herein) IL-6R or IL-6R mediated signalling via the same mechanism of action as M182.

Such biparatopic (or multiparatopic) polypeptides of the invention preferably comprise at least two amino acid sequences and/or Nanobodies that are capable, upon binding to IL-6R, (i) to modulate, and in particular inhibit and/or prevent, binding of the IL-6/IL-6R complex to gp130 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways, or more generally capable of modulating (as defined herein) IL-6R or IL-6R mediated signalling via the same mechanism of action as M182. Such biparatopic (or multiparatopic) polypeptides of the invention preferably comprise at least two amino acid sequences and/or Nanobodies that are directed against an epitope that lies in, forms part of, or overlaps with (i.e. in the primary or tertiary structure) or is in close proximity to (i.e. in the primary or tertiary structure) to the M182 binding site on IL-6R (for example, competitively with M182) and/or that are capable of competing with M182 for binding to IL-6R. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the M182 binding site on IL-6R; and preferably comprise single variable domains and more preferably Nanobodies).

In another preferred, but non-limiting aspect, the biparatopic (or multiparatopic) polypeptides of the invention are at least directed against an epitope that lies in, forms part of, or overlaps with (i.e. in the primary or tertiary structure) or is in close proximity to (i.e. in the primary or tertiary structure) the IL-6 binding site on IL-6R (preferably, one or more of the 18 contact residues as described in Boulanger et al. 2003 (Science 300, 2101-2104) present in the extracellular 03 domain of the IL-6R, more preferably amino acid residues Phe229 and Phe279 present in the extracellular D3 domain of the IL-6R; for example, competitively with IL-6) and/or are capable of competing with IL-6 for binding to IL-6R as well as against an epitope that lies in, forms part of, or overlaps with (i.e. in the primary or tertiary structure) or is in close proximity to (i.e. in the primary or tertiary structure) the BN-12 binding site on IL-6R (for example, competitively with BN-12) and/or are capable of competing with BN-12 for binding to IL-6R. Again, the above biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the IL-6 binding site and the BN-12 binding site on IL-6R; and preferably comprise single variable domains and more preferably Nanobodies).

In another preferred, but non-limiting aspect, the amino acid sequences and (in particular) polypeptides of the invention are biparatopic (or multiparatopic) and are at least capable, upon binding to IL-6R, (1) to modulate, and in particular inhibit and/or prevent binding of IL-6R to IL-6 and/or binding of the IL-6/IL-6R complex to gp130 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways.

Such biparatopic (or multiparatopic) polypeptides of the invention preferably comprise at least one amino acid sequence and/or Nanobody that is capable, upon binding to IL-6R, (i) to modulate, and in particular inhibit and/or prevent binding of IL-6R to IL-6 and/or binding of IL-6R to IL-6 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways; as well as at least one further amino acid sequence and/or Nanobody that is capable, upon binding to IL-6R, (i) to modulate, and in particular inhibit and/or prevent binding of IL-6R to IL-6 and/or binding of the IL-6/IL-6R complex to gp130 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways. Such biparatopic (or multiparatopic) polypeptides of the invention preferably comprise at least one amino acid sequence and/or Nanobody that is directed against an epitope that lies in, forms part of, or overlaps with (i.e. in the primary or tertiary structure) or is in close proximity to (i.e. in the primary or tertiary structure) to the IL-6 binding site on IL-6R (preferably, one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R; for example, competitively with IL-6) and/or are capable of competing with IL-6 for binding to IL-6R, as well as at least one further amino add sequence and/or Nanobody that is directed against an epitope that lies in, forms part of, or overlaps with (i.e. in the primary or tertiary structure) or is in close proximity to (i.e. in the primary or tertiary structure) to the BN-12 binding site on IL-6R (for example, competitively with BN-12) and/or that is capable of competing with BN-12 for binding to IL-6R. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the IL-6 binding site and the BN-12 binding site on IL-6R; and preferably comprise single variable domains and more preferably Nanobodies).

In another preferred, but non-limiting aspect, the biparatopic (or multiparatopic) polypeptides of the invention are at least directed against an epitope that lies in, forms part of, or overlaps with (i.e. in the primary or tertiary structure) or is in close proximity to (i.e. in the primary or tertiary structure) the BN-12 binding site on IL-6R (for example, competitively with BN-12) and/or are capable of competing with BN-12 for binding to IL-6R as well as against an epitope that lies in, forms part of, or overlaps with (i.e. in the primary or tertiary structure) or is in close proximity to (i.e. in the primary or tertiary structure) the gp130 binding site on IL-6R and/or the IL-6/IL-6R complex (for example, competitively with gp130) and/or are capable of competing with gp130 for binding to the IL-6/IL-6R complex. Again, the above biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the BN-12 binding site on IL-6R and the gp130 binding site on IL-6R and/or the IL-6/IL-6R complex; and preferably comprise single variable domains and more preferably Nanobodies).

In another preferred, but non-limiting aspect, the amino acid sequences and (in particular) polypeptides of the invention are biparatopic (or multiparatopic) and are at least capable, upon binding to IL-6R, (i) to modulate, and in particular inhibit and/or prevent binding of IL-6R to IL-6 and/or binding of the IL-6/IL-6R complex to gp130 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways.

Such biparatopic (or multiparatopic) polypeptides of the invention preferably comprise at least one amino acid sequence and/or Nanobody that is capable, upon binding to IL-6R, (i) to modulate, and in particular inhibit and/or prevent binding of IL-6R to IL-6 and/or binding of the IL-6/IL-6R complex to gp130 and thus (ii) to modulate, and in particular inhibit or prevent the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways; as well as at least one further amino acid sequence and/or Nanobody that is capable, upon binding to IL-6R, (i) to modulate, and in particular inhibit and/or prevent, binding of the IL-6/IL-6R complex to gp130 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways. Such biparatopic (or multiparatopic) polypeptides of the invention preferably comprise at least one amino acid sequence and/or Nanobody that is directed against an epitope that lies in, forms part of, or overlaps with (i.e. in the primary or tertiary structure) or is in close proximity to (i.e. in the primary or tertiary structure) to the BN-12 binding site on IL-6R (for example, competitively with BN-12) and/or are capable of competing with BN-12 for binding to IL-6R, as well as at least one further amino acid sequence and/or Nanobody that is directed against an epitope that lies in, forms part of, or overlaps with (i.e. in the primary or tertiary structure) or is in close proximity to (i.e. in the primary or tertiary structure) to the gp130 binding site on IL-6R the IL-6/IL-6R complex (for example, competitively with gp130) and/or that is capable of competing with gp130 for binding to the IL-6/IL-6R complex. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the BN-12 binding site on IL-6R and the gp130 binding site on IL-6R and/or the IL-6/IL-6R complex; and preferably comprise single variable domains and more preferably Nanobodies).

In another preferred, but non-limiting aspect, the biparatopic (or multiparatopic) polypeptides of the invention are at least directed against an epitope that lies in, forms part of, or overlaps with (i.e. in the primary or tertiary structure) or is in close proximity to (i.e. in the primary or tertiary structure) the binding site for the reference IgG and/or the reference Fab on IL-6R (for example, competitively with the reference IgG and/or the reference Fab) and/or are capable of competing with the reference IgG and/or the reference Fab for binding to IL-6R as well as against an epitope that lies in, forms part of, or overlaps with (i.e. in the primary or tertiary structure) or is in close proximity to (i.e. in the primary or tertiary structure) the BN-12 binding site on IL-6R (for example, competitively with BN-12) and/or are capable of competing with BN-12 for binding to IL-6R. Again, the above biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the binding site for the reference IgG and/or the reference Fab and the BN-12 binding site on IL-6R; and preferably comprise single variable domains and more preferably Nanobodies).

In another preferred, but non-limiting aspect, the biparatopic (or multiparatopic) polypeptides of the invention are at least capable, upon binding to IL-6R, (i) to modulate, and in particular inhibit and/or prevent, binding of IL-6R to IL-6 and/or binding of the IL-6/IL-6R complex to gp130 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways, or more generally capable of modulating (as defined herein) IL-6R or IL-6R mediated signalling via the same mechanism of action as the reference IgG and/or the reference Fab.

Such biparatopic (or multiparatopic) polypeptides of the invention preferably comprise at least one amino acid sequence and/or Nanobody that is capable, upon binding to IL-6R, (1) to modulate, and in particular inhibit and/or prevent, binding of IL-6R to IL-6 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways, or more generally capable of modulating (as defined herein) IL-6R or IL-6R mediated signalling via the same mechanism of action as the reference IgG and/or the reference Fab; as well as at least one further amino acid sequence and/or Nanobody that is capable, upon binding to IL-6R, (i) to modulate, and in particular inhibit and/or prevent binding of IL-6R to IL-6 and/or binding of the IL-6/IL-6R complex to gp130 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways. Such biparatopic (or multiparatopic) polypeptides of the invention preferably comprise at least one amino acid sequence and/or Nanobody that is directed against an epitope that lies in, forms part of, or overlaps with (i.e. in the primary or tertiary structure) or is in close proximity to (i.e. in the primary or tertiary structure) to the binding site for the reference IgG and/or the reference Fab on IL-6R (for example, competitively with the reference IgG and/or the reference Fab) and/or are capable of competing with the reference IgG and/or the reference Fab for binding to IL-6R, as well as at least one further amino acid sequence and/or Nanobody of the invention that is directed against an epitope that lies in, forms part of, or overlaps with (i.e. in the primary or tertiary structure) or is in close proximity to (i.e. in the primary or tertiary structure) to the BN-12 binding site on IL-6R (for example, competitively with BN-12) and/or that is capable of competing with BN-12 for binding to IL-6R. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the binding site for the reference IgG and/or the reference Fab and the BN-1 binding site on IL-6R; and preferably comprise single variable domains and more preferably Nanobodies).

In another preferred, but non-limiting aspect, the biparatopic (or multiparatopic) polypeptides of the invention are at least directed against an epitope that lies in, forms part of, or overlaps with (i.e. in the primary or tertiary structure) or is in close proximity to (i.e. in the primary or tertiary structure) the BN-12 binding site on IL-6R (for example, competitively with BN-12) and/or are capable of competing with BN-12 for binding to IL-6R as well as against an epitope that lies in, forms part of, or overlaps with (i.e. in the primary or tertiary structure) or is in close proximity to (i.e. in the primary or tertiary structure) the Tocilizumab (MRA) binding site on IL-6R (for example, competitively with Tocilizumab (MRA)) and/or are capable of competing with Tocilizumab (MRA) for binding to IL-6R. Again, the above biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the binding site for the BN-12 and the Tocilizumab (MRA) binding site on IL-6R; and preferably comprise single variable domains and more preferably Nanobodies).

In another preferred, but non-limiting aspect, the amino acid sequences and (in particular) polypeptides of the invention are biparatopic (or multiparatopic) and are at least capable, upon binding to IL-6R, (i) to modulate, and in particular inhibit and/or prevent, binding of IL-6R to IL-6 and/or binding of the IL-6/IL-6R complex to gp130 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways, or more generally capable of modulating (as defined herein) IL-6R or IL-6R mediated signalling via the same mechanism of action as Tocilizumab (MRA).

Such biparatopic (or multiparatopic) polypeptides of the invention preferably comprise at least one amino acid sequence and/or Nanobody that is capable, upon binding to IL-6R, (i) to modulate, and in particular inhibit and/or prevent binding of IL-6R to IL-6 and/or binding of the IL-6/IL-6R complex to gp130 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways; as well as at least one further amino acid sequence and/or Nanobody that is capable, upon binding to IL-6R, (i) to modulate, and in particular inhibit and/or prevent, binding of IL-6R to IL-6 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways, or more generally capable of modulating (as defined herein) IL-6R or IL-6R mediated signalling via the same mechanism of action as Tocilizumab (MRA). Such biparatopic (or multiparatopic) polypeptides of the invention preferably comprise at least one amino acid sequence and/or Nanobody that is directed against an epitope that lies in, forms part of, or overlaps with (i.e. in the primary or tertiary structure) or is in close proximity to (i.e. in the primary or tertiary structure) to the BN-12 binding site on IL-6R (for example, competitively with BN-12) and/or are capable of competing with BN-12 for binding to IL-6R, as well as at least one further amino acid sequence and/or Nanobody that is directed against an epitope that lies in, forms part of, or overlaps with (i.e. in the primary or tertiary structure) or is in close proximity to (i.e. in the primary or tertiary structure) to the Tocilizumab (MRA) binding site on IL-6R (for example, competitively with Tocilizumab (MRA)) and/or that is capable of competing with Tocilizumab (MRA) for binding to IL-6R. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the BN-12 binding site and the Tocilizumab (MRA) binding site on IL-6R; and preferably comprise single variable domains and more preferably Nanobodies).

In another preferred, but non-limiting aspect, the biparatopic (or multiparatopic) polypeptides of the invention are at least directed against an epitope that lies in, forms part of, or overlaps with (i.e. in the primary or tertiary structure) or is in close proximity to (i.e. in the primary or tertiary structure) the M182 binding site on IL-6R (for example, competitively with M182) and/or are capable of competing with M182 for binding to IL-6R as well as against an epitope that lies in, forms part of, or overlaps with (i.e. in the primary or tertiary structure) or is in close proximity to (i.e. in the primary or tertiary structure) the BN-12 binding site on IL-6R (for example, competitively with BN-12) and/or are capable of competing with BN-12 for binding to IL-6R. Again, the above biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the binding site for the M182 and the BN-12 binding site on IL-6R; and preferably comprise single variable domains and more preferably Nanobodies).

In another preferred, but non-limiting aspect, the amino acid sequences and (in particular) polypeptides of the invention are biparatopic (or multiparatopic) and are at least capable, upon binding to IL-6R, (1) to modulate, and in particular inhibit and/or prevent, binding of IL-6R to IL-6 and/or binding of the IL-6/IL-6R complex to gp130 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways, or more generally capable of modulating (as defined herein) IL-6R or IL-6R mediated signalling via the same mechanism of action as M182.

Such biparatopic (or multiparatopic) polypeptides of the invention preferably comprise at least one amino acid sequence and/or Nanobody that is capable, upon binding to IL-6R, (i) to modulate, and in particular inhibit and/or prevent, binding of the IL-6/IL-6R complex to gp130 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways, or more generally capable of modulating (as defined herein) IL-6R or IL-6R mediated signalling via the same mechanism of action as M182; as well as at least one further amino acid sequence and/or Nanobody that is capable, upon binding to IL-6R, (i) to modulate, and in particular inhibit and/or prevent, binding of IL-6R to IL-6 and/or binding of the IL-6/IL-6R complex to gp130 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways. Such biparatopic (or multiparatopic) polypeptides of the invention preferably comprise at least one amino acid sequence and/or Nanobody that is directed against an epitope that lies in, forms part of, or overlaps with (i.e. in the primary or tertiary structure) or is in close proximity to (i.e. in the primary or tertiary structure) to the M182 binding site on IL-6R (for example, competitively with M182) and/or are capable of competing with M182 for binding to IL-6R, as well as at least one further amino acid sequence and/or Nanobody that is directed against an epitope that lies in, forms part of, or overlaps with (i.e. in the primary or tertiary structure) or is in close proximity to (i.e. in the primary or tertiary structure) to the BN-12 binding site on IL-6R (for example, competitively with BN-12) and/or that is capable of competing with BN-12 for binding to IL-6R. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the M182 binding site and the BN-12 binding site on IL-6R; and preferably comprise single variable domains and more preferably Nanobodies).

In another preferred, but non-limiting aspect, the biparatopic (or multiparatopic) polypeptides of the invention may have both paratopes directed against an epitope that lies in, forms part of, or overlaps with (i.e. in the primary or tertiary structure) or is in close proximity to (i.e. in the primary or tertiary structure) the BN-12 binding site on IL-6R (for example, competitively with BN-12) and/or both capable of competing with BN-12 for binding to IL-6R.

Again, the above biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind both binding sites on IL-6R; and preferably comprise single variable domains and more preferably Nanobodies).

In another preferred, but non-limiting aspect, the biparatopic (or multiparatopic) polypeptides of the invention are at least capable, upon binding to IL-6R, (1) to modulate, and in particular inhibit and/or prevent binding of IL-6R to IL-6 and/or binding of the IL-6/IL-6R complex to gp130 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways.

Such biparatopic (or multiparatopic) polypeptides of the invention preferably comprise at least two amino acid sequences and/or Nanobodies that are capable, upon binding to IL-6R, (i) to modulate, and in particular inhibit and/or prevent binding of IL-6R to IL-6 and/or binding of the IL-6/IL-6R complex to gp130 and thus (ii) to modulate, and in particular inhibit or prevent, the signalling that is mediated by IL-6, IL-6R, IL-6/IL-6R complex and/or gp130, (iii) to modulate the biological pathways in which IL-6, IL-6R, the IL6/IL-6R complex and/or gp130 are involved, and/or (iv) to modulate the biological mechanisms, responses and effects associated with such signalling or these pathways. Such biparatopic (or multiparatopic) polypeptides of the invention preferably comprise at least two amino acid sequences and/or Nanobodies that are directed against an epitope that lies in, forms part of, or overlaps with (i.e. in the primary or tertiary structure) or is in close proximity to (i.e. in the primary or tertiary structure) to the BN-12 binding site on IL-6R (for example, competitively with BN-12) and/or that are capable of competing with BN-12 for binding to IL-6R. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind both binding site on IL-6R; and preferably comprise single variable domains and more preferably Nanobodies).

In the context of the present invention, for amino acid sequences and/or Nanobodies described above (and/or polypeptides comprising the same) that are directed against an epitope that lies in, forms part of, or overlaps with (i.e. in the primary or tertiary structure) or is in close proximity to (i.e. in the primary or tertiary structure) the IL-6 binding site on IL-6R (for example, competitively with IL-6) and/or that are capable of competing with IL-6 for binding to IL-6R, the term "modulating the interaction between IL-6R and IL-6", "modulating the binding of IL-6R to IL-6" and/or "inhibiting and/or preventing binding of IL-6R to IL-6" means binding to IL-6R in such a way that the formation of the IL-6/IL-6R complex is inhibited or affected (e.g. fully or partially disrupted) in such a way that the binding of IL-6 to—e.g. its affinity for—IL-6R is reduced (or reversely, that the binding of IL-6R to—e.g. its affinity for—IL-6 is reduced), so that the signalling, pathway(s) and/or mechanism(s) induced/mediated by the binding of IL-6 to IL-6R is modulated (e.g. reduced) compared to the signalling, pathway(s) and/or mechanism(s) induced/mediated by the binding of IL-6 to IL-6R without the presence of the amino acid sequence and/or Nanobody described above (and/or polypeptide comprising the same).

Preferred biparatopic polypeptides of the invention are selected from SEQ ID NO's: 828-963

In the context of the present invention, for amino acid sequences and/or Nanobodies described above (and/or polypeptides comprising the same) that are directed against an epitope that lies in, forms part of, or overlaps with (i.e. in the primary or tertiary structure) or is in close proximity to (i.e. in the primary or tertiary structure) the IL-6 binding site on IL-6R (for example, competitively with IL-6) and/or that are capable of competing with IL-6 for binding to IL-6R, the term "modulating the interaction between IL-6/IL-6R complex and gp130", "modulating binding of the IL-6/IL-6R complex to gp130" and/or "inhibiting and/or preventing binding of the IL-6/IL-6R complex to gp130" means binding to IL-6R (i.e. as such or as present in the IL-6/IL-6R complex) in such a way that the formation of the IL-6/IL-6R complex is inhibited or affected (e.g. fully or partially disrupted) in such a way that the binding of the complex to—e.g. its affinity for—gp130 is reduced (or reversely, that the binding of gp 130 to—e.g. its affinity for—the complex is reduced), so that the signalling, pathway(s) and/or mechanism(s) induced/mediated by the binding of the complex to gp130 is modulated (e.g. reduced) compared to the formation of the complex and its binding to gp130 without the presence of the amino acid sequence and/or Nanobody described above (and/or polypeptide comprising the same).

In the context of the present invention, for amino acid sequences and/or Nanobodies described above (and/or polypeptides comprising the same) that are directed against an epitope that lies in, forms part of, or overlaps with (i.e. in the primary or tertiary structure) or is in close proximity to (i.e. in the primary or tertiary structure) the gp130 binding site on IL-6R and/or the IL-6/IL-6R complex (for example, competitively with gp130); and/or are capable of competing with gp130 for binding to the IL-6/IL-6R complex, the term "modulating the interaction between IL-6R and IL-6", "modulating the binding of IL-6R to (L-6" and/or "inhibiting and/or preventing binding of IL-6R to IL-6" means binding to IL-6R in such a way that the formation of the IL-6/IL-6R complex is inhibited or affected (e.g. fully or partially disrupted) in such a way that the binding of IL-6 to—e.g. its affinity for—IL-6R is reduced (or reversely, that the binding of IL-6R to—e.g. its affinity for—IL-6 is reduced), so that the signalling, pathway(s) and/or mechanism(s) induced/mediated by the binding of IL-6 to IL-6R is modulated (e.g. reduced) compared to the signalling, pathway(s) and/or mechanism(s) induced/mediated by the binding of IL-6 to IL-6R without the presence of the amino acid sequence and/or Nanobody described above (and/or polypeptide comprising the same).

In the context of the present invention, for amino acid sequences and/or Nanobodies described above (and/or polypeptides comprising the same) that are directed against an epitope that lies in, forms part of, or overlaps with (i.e. in the primary or tertiary structure) or is in close proximity to (i.e. in the primary or tertiary structure) the gp130 binding site on IL-6R and/or the IL-6/IL-6R complex (for example, competitively with gp130); and/or are capable of competing with gp130 for binding to the IL-6/IL-6R complex, the term "modulating the interaction between IL-6/IL-6R complex and gp130", "modulating binding of the IL-6/IL-6R complex to gp130" and/or "inhibiting and/or preventing binding of the IL-6/IL-6R complex to gp130" means binding to IL-6R (i.e. as such or as present in the IL-6/IL-6R complex) in such a way that the formation of the IL-6/IL-6R complex essentially is not affected but that the binding of said complex to gp130 is modulated (e.g. inhibited), so that the signalling, pathway(s) and/or mechanism(s) induced/mediated by the binding of the complex to gp130 is modulated (e.g. reduced) compared to the binding of the complex to gp130 without the presence of the amino acid sequence and/or Nanobody described above (and/or polypeptide comprising the same).

As such, the biparatopic (or multiparatopic) polypeptides of the invention may at least be capable, upon binding to IL-6R,
  (i) to inhibit or affect (e.g. fully or partially disrupt) the formation of the IL-6/IL-6R complex in such a way that the binding of IL-6 to—e.g. its affinity for—IL-6R is reduced (or reversely, that the binding of IL-6R to—e.g. its affinity for—IL-6 is reduced), so that the signalling, pathway(s) and/or mechanism(s) induced/mediated by the binding of IL-6 to IL-6R is modulated (e.g. reduced) compared to the signalling, pathway(s) and/or mechanism(s) induced/mediated by the binding of IL-6 to IL-6R without the presence of the amino acid sequence and/or polypeptide of the invention; and
  (ii) to inhibit or affect (e.g. fully or partially disrupt) the formation of the IL-6/IL-6R complex is in such a way that the binding of the complex to—e.g. its affinity for—gp130 is reduced (or reversely, that the binding of gp 130 to—e.g. its affinity for—the complex is reduced), so that the signalling, pathway(s) and/or mechanism(s) induced/mediated by the binding of the complex to gp130 is modulated (e.g. reduced) compared to the signalling, pathway(s) and/or mechanism(s) induced/mediated by the binding of the complex to gp130 without the presence of the amino acid sequence or Nanobody of the invention.

The biparatopic (or multiparatopic) polypeptides of the invention may at least be capable, upon binding to IL-6R,
  (i) to inhibit or affected (e.g. fully or partially disrupt) the formation of the IL-6/IL-6R complex in such a way that the binding of IL-6 to—e.g. its affinity for—IL-6R is reduced (or reversely, that the binding of IL-6R to—e.g. its affinity for—IL-6 is reduced), so that the signalling, pathway(s) and/or mechanism(s) induced/mediated by the binding of IL-6 to IL-6R is modulated (e.g. reduced) compared to the signalling, pathway(s) and/or mechanism(s) induced/mediated by the binding of IL-6 to IL-6R without the presence of the amino acid sequence and/or polypeptide of the invention; and
  (ii) to modulate (e.g. inhibit) the binding of the IL-6/IL-6R complex to gp130, so that the signalling, pathway(s) and/or mechanism(s) induced/mediated by the binding of the IL-6/IL-6R complex to gp130 is modulated (e.g. reduced) compared to the signalling, pathway(s) and/or mechanism(s) induced/mediated by the binding of the IL-6/IL-6R complex to gp130 without the presence of the amino acid sequence and/or polypeptide of the invention.

The biparatopic (or multiparatopic) polypeptides of the invention may at least be capable, upon binding to IL-6R, (i) to inhibit or affect (e.g. fully or partially disrupt) the formation of the IL-6/IL-6R complex is in such a way that the binding of the complex to—e.g. its affinity for—gp130 is reduced (or reversely, that the binding of gp 130 to—e.g. its affinity for—the complex is reduced), so that the signalling, pathway(s) and/or mechanism(s) induced/mediated by the binding of the complex to gp130 is modulated (e.g. reduced) compared to the signalling, pathway(s) and/or mechanism(s) induced/mediated by the binding of the complex to gp130 without the presence of the amino acid sequence or Nanobody of the invention; and (ii) to modulate (e.g. inhibit) the binding of the IL-6/IL-6R complex to gp130, so that the signalling, pathway(s) and/or mechanism(s) induced/mediated by the binding of the IL-6/IL-6R complex to gp130 is modulated (e.g. reduced) compared to the signalling, pathway(s) and/or mechanism(s) induced/mediated by the binding of the IL-6/IL-6R complex to gp130 without the presence of the amino acid sequence and/or polypeptide of the invention.

The biparatopic (or multiparatopic) polypeptides of the invention may at least be capable, upon binding to IL-6R, (i) to inhibit or affected (e.g. fully or partially disrupt) the formation of the IL-6/IL-6R complex in such a way that the binding of IL-6 to—e.g. its affinity for IL-6R is reduced (or reversely, that the binding of IL-6R to—e.g. its affinity for—IL-6 is reduced), so that the signalling, pathway(s) and/or mechanism(s) induced/mediated by the binding of IL-6 to IL-6R is modulated (e.g. reduced) compared to the signalling, pathway(s) and/or mechanism(s) induced/mediated by the binding of IL-6 to IL-6R without the presence of the amino acid sequence and/or polypeptide of the invention;

(ii) to inhibit or affect (e.g. fully or partially disrupt) the formation of the IL-6/IL-6R complex is in such a way that the binding of the complex to—e.g. its affinity for—gp130 is reduced (or reversely, that the binding of gp 130 to—e.g. its affinity for—the complex is reduced), so that the signalling, pathway(s) and/or mechanism(s) induced/mediated by the binding of the complex to gp130 is modulated (e.g. reduced) compared to the signalling, pathway(s) and/or mechanism(s) induced/mediated by the binding of the complex to gp130 without the presence of the amino acid sequence or Nanobody of the invention; and (iii) to modulate (e.g. inhibit) the binding of the IL-6/IL-6R complex to gp130, so that the signalling, pathway(s) and/or mechanism(s) induced/mediated by the binding of the IL-6/IL-6R complex to gp130 is modulated (e.g. reduced) compared to the signalling, pathway(s) and/or mechanism(s) induced/mediated by the binding of the IL-6/IL-6R complex to gp130 without the presence of the amino acid sequence and/or polypeptide of the invention.

The biparatopic (or multiparatopic) polypeptide of the invention or the composition comprising the same should at least "modulate" or effect a change (i.e. an activity, preferably as an antagonist) with respect to at least one the pathway(s) or mechanism(s) in which IL-6, IL-6R, the IL-6/IL-6R complex and/or gp130 (or its pathway(s)) are involved (such as its signalling pathway or metabolic pathway and their associated biological or physiological effects). In one aspect, the biparatopic (or multiparatopic) polypeptide of the invention or the composition comprising the same may "modulate" or effect a change with respect to more than one (such as two, three, four or even more) biological or physiological pathways or mechanisms (i.e. the biparatopic (or multiparatopic) polypeptide of the invention or the composition comprising the same may have more than one mode of action). The different modes of action may be mediated each by one of the binding units (as further defined herein) of the biparatopic polypeptide of the invention, wherein each binding unit binds at a different binding site of IL-6R.

In a preferred aspect, the biparatopic polypeptide of the invention may modulate the signalling, pathway(s) and/or mechanism(s) induced/mediated by the binding of IL-6 to IL-6R and at the same time modulate the signalling, pathway(s) and/or mechanism(s) induced/mediated by the binding of the IL-6/IL-6R complex to gp130. In another preferred aspect, the biparatopic polypeptide of the invention may combine the modes of action of Tocilizumab (MRA) and M182, the modes of action of the reference IgG and/or reference Fab and M182.

Accordingly, the present invention also relates to a biparatopic (or multiparatopic) polypeptide or a composition comprising the same that combines two different modes of action each mediated by one of the binding units of the biparatopic polypeptide of the invention, wherein each binding unit binds at a different binding site of IL-6R.

The amino acid sequences and/or Nanobodies that form (i.e. are comprised in, are encompassed in, are used to generate and/or make up) the biparatopic (or multiparatopic) polypeptides of the invention can be any amino acid sequence and/or Nanobody that is capable of binding to at least one antigenic determinant, epitope, part or domain on IL-6R. Preferred amino acid sequences and/or Nanobodies are e.g. described in WO 08/020,079 and/or are described herein (referred to herein as "amino acid sequence of the invention" and "Nanobody of the invention").

Preferably, the amino acid sequences and/or Nanobodies that form (i.e. are comprised in, are encompassed in, are used to generate and/or make up) the biparatopic (or multiparatopic) polypeptides of the invention may bind to IL-6R with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein.

In particular, the amino acid sequences and/or Nanobodies that form (i.e. are comprised in, are encompassed in, are used to generate and/or make up) the biparatopic (or multiparatopic) polypeptides of the invention are preferably such that they:

bind to IL-6R with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles);

and/or such that they:

bind to IL-6R with a $k_{off}$ rate of between $10^2$ $M^{-1}s^4$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$;

and/or such that they:

bind to IL-6R with a $k_{off}$ rate between $1s^{-1}$ ($t_{1/2}$=0.69 s) and $10^{-6}$ $s^{-1}$ (providing a near irreversible complex with a $t_{1/2}$ of multiple days), preferably between $10^{-2}$ $s^{-1}$ and $10^{-6}$ $s^{-1}$, more preferably between $10^{-3}$ $s^{-1}$ and $10^{-5}$ $s^{-1}$, such as between $10^{-4}s^{-1}$ and $10^{-5}$ $s^{-1}$.

Preferably, a monovalent amino acid sequence of the invention (or a polypeptide that contains only one amino acid sequence of the invention) is preferably such that it will bind to IL-6R with an affinity less than 500 nM, preferably less than 200 nM, more preferably less than 10 nM, such as less than 500 µM.

Some preferred IC50 values for binding of the amino acid sequences, Nanobodies and/or polypeptides of the invention to IL-6R will become clear from the further description and examples herein.

Figure 3:
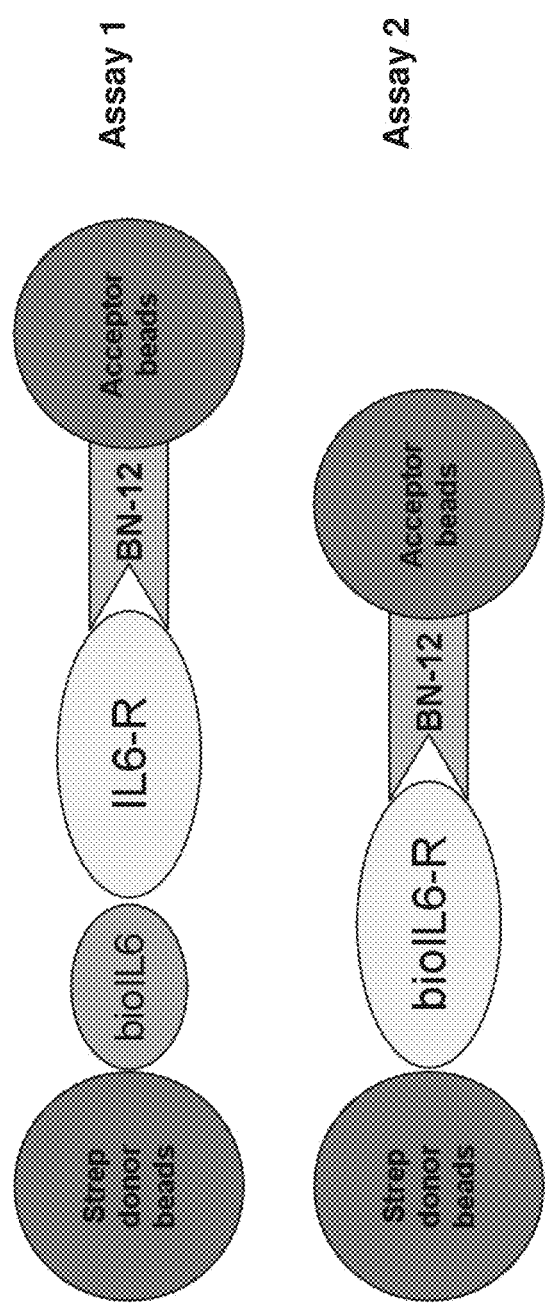
FIG. 3: Schematic representation of Alphascreen assays used to identify Nanobodies against the IL-6 binding site on IL-6R.

Also, according to the invention, amino acid sequences and/or Nanobodies that form (i.e. are comprised in, are encompassed in, are used to generate and/or make up) the biparatopic (or multiparatopic) polypeptides of the invention that are directed against IL-6R from a first species of warm-blooded animal may or may not show cross-reactivity with IL-6R from one or more other species of warm-blooded animal, by which is meant that these amino acid sequences are also "directed against" (as defined herein) and/or are capable of specific binding to (as defined herein) IL-6R from said warm-blooded animal. For example, amino acid sequences and/or Nanobodies directed against human IL-6R may or may not show cross reactivity with IL-6R from one or more other species of primates (such as, without limitation, monkeys from the genus *Macaca* (such as, and in particular, cynomologus monkeys (*Macaca fascicularis*) and/or rhesus monkeys (*Macaca mulatto*)) and baboon (*Papio ursinus*)) and/or with IL-6R from one or more species of animals that are often used in animal models for diseases (for example mouse, rat, rabbit, pig or dog), and in particular in animal models for diseases and disorders associated with IL-6R (such as the species and animal models mentioned herein). In this respect, it will be clear to the skilled person that such cross-reactivity, when present, may have advantages from a drug development point of view, since it allows the amino acid sequences, Nanobodies and/or biparatopic (or multiparatopic) polypeptides against human IL-6R to be tested in such disease models. In a preferred but non-limiting aspect, the amino acid sequences and/or Nanobodies that form (i.e. are comprised in, are encompassed in, are used to generate and/or make up) the biparatopic (or multiparatopic) polypeptides of the invention may be cross-reactive with the amino acid sequence for IL-6R from *Macaca fascicularis*. For this sequence and the corresponding cDNA sequence, reference is also made to WO 09/010,539 (see SEQ ID NO: 3 and FIG. 1B for the cDNA sequence and SEQ ID NO: 4 and FIG. 3B for the amino acid sequence).

More generally, amino acid sequences, Nanobodies and/or biparatopic (or multiparatopic) polypeptides of the invention that are cross-reactive with IL-6R from multiple species of mammal will usually be advantageous for use in veterinary applications, since it will allow the same amino acid sequence, Nanobody and/or polypeptide to be used across multiple species. Thus, it is also encompassed within the scope of the invention that amino acid sequences, Nanobodies and/or polypeptides directed against IL-6R from one species of animal (such as amino acid sequences, Nanobodies and/or and polypeptides against human IL-6R) can be used in the treatment of another species of animal, as long as the use of the amino acid sequences, Nanobodies and/or polypeptides provide the desired effects in the species to be treated.

In its broadest sense, the amino acid sequences and/or Nanobodies that form (i.e. are comprised in, are encompassed in, are used to generate and/or make up) the biparatopic (or multiparatopic) polypeptides of the invention are not particularly limited to binding or defined by a specific antigenic determinant, epitope, part or domain of IL-6R against which they are directed. However, it is generally assumed and preferred that these amino acid sequences and/or Nanobodies are preferably directed against any epitope of the IL-6 receptor involved in the interaction of the IL-6 receptor with IL-6.

Such epitopes or interaction sites have been described in detail in Boulanger et al. (2003, Science 300: 2101-2104) and reference is specifically made to FIG. 2 in cited reference. More preferably, these amino acid sequences and/or Nanobodies may be directed against an extracellular domain of the IL-6 receptor, such as the D1 domain, the D2 domain and/or the D3 domain. Still more preferably, these amino acid sequences and/or Nanobodies may be directed against the extracellular D3 domain of the IL-6 receptor. Still more preferably, these amino acid sequences and/or Nanobodies interact with one or more of the 18 contact residues as described in Boulanger et al. 2003 (Science 300, 2101-2104) present in the extracellular D3 domain of the IL-6 receptor that contribute to the interaction of the IL-6 receptor with IL-6. Most preferably, these amino acid sequences and/or Nanobodies interact with amino acid residues Phe229 and Phe279 present in the extracellular D3 domain of the IL-6 receptor.

Thus, in one preferred, but non-limiting aspect, the amino acid sequences and/or Nanobodies that form (i.e. are comprised in, are encompassed in, are used to generate and/or make up) the biparatopic (or multiparatopic) polypeptides of the invention are directed against any epitope of the IL-6 receptor involved in the interaction of the IL-6 receptor with IL-6, and are as further defined herein.

Alternatively the amino acid sequences and/or Nanobodies that form (i.e. are comprised in, are encompassed in, are used to generate and/or make up) the biparatopic (or multiparatopic) polypeptides of the invention are directed against any epitope of the IL-6 receptor involved in the interaction of the IL-6 receptor with gp130. Such epitopes or interaction sites have been described in detail in Boulanger et al. (2003, Science 300: 2101-2104) and reference is specifically made to FIG. 2 in cited reference.

In this context, according to a non-limiting aspect, these amino acid sequences and/or Nanobodies are preferably such that they can compete for binding to the IL-6 receptor with the commercially available human-mouse reconstituted chimeric monoclonal anti-IL6R antibody Tocilizumab (MRA) (Chugai/Roche) or an antigen binding fragment thereof (see for example WO 92/19759 and corresponding European patent EP 0628639, as well as Shinkura et al. 1998, Anticancer Research 18: 1217-1222), for example in the assay described in Example 11; and/or such that they can bind to the same epitope or binding site on IL-6R as Tocilizumab (MRA), or to an epitope close to said binding site and/or overlapping with said binding site.

Also, according to a non-limiting aspect, these amino acid sequences and/or Nanobodies are preferably such that they can compete for binding to the IL-6 receptor with the reference IgG and/or reference Fab according to patent EP 0628639; and/or such that they can bind to the same epitope or binding site on IL-6R as said reference IgG or reference Fab, or to an epitope close to said binding site and/or overlapping with said binding site. For the preparation and sequence of said reference IgG and reference Fab, reference is made to Example 1 below, as well as to SEQ ID NO's: 126 to 129.

Thus, generally and without limitation, the amino acid sequences and/or Nanobodies that form (i.e. are comprised in, are encompassed in, are used to generate and/or make up)

the biparatopic (or multiparatopic) polypeptides of the invention may be directed against any epitope of the IL-6 receptor involved in the interaction of the IL-6 receptor with IL-6 and/or gp130.

In one specific, but non-limiting aspect, the amino acid sequence that forms (i.e. is comprised in, is encompassed in, is used to generate and/or make up) the biparatopic (or multiparatopic) polypeptides of the invention may be an amino acid sequence that comprises an immunoglobulin fold or may be an amino acid sequence that, under suitable conditions (such as physiological conditions) is capable of forming an immunoglobulin fold (i.e. by folding). Reference is inter alia made to the review by Halaby et al., J. (1999) Protein Eng. 12, 563-71. Preferably, when properly folded so as to form an immunoglobulin fold, such an amino acid sequence is capable of specific binding (as defined herein) to IL-6R; and more preferably capable of binding to IL-6R with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein. Also, parts, fragments, analogs, mutants, variants, alleles and/or derivatives of such amino acid sequences are preferably such that they comprise an immunoglobulin fold or are capable for forming, under suitable conditions, an immunoglobulin fold.

In particular, but without limitation, the amino acid sequence may be amino acid sequence that essentially consists of 4 framework regions (FR1 to FR4 respectively) and 3 complementarity determining regions (CDR1 to CDR3 respectively); or any suitable fragment of such an amino acid sequence (which will then usually contain at least some of the amino acid residues that form at least one of the CDR's, as further described herein).

The amino acid sequence may in particular be an immunoglobulin sequence or a suitable fragment thereof, and more in particular be an immunoglobulin variable domain sequence or a suitable fragment thereof, such as light chain variable domain sequence (e.g. a $V_L$-sequence) or a suitable fragment thereof; or a heavy chain variable domain sequence (e.g. a $V_H$-sequence) or a suitable fragment thereof. When the amino acid sequence is a heavy chain variable domain sequence, it may be a heavy chain variable domain sequence that is derived from a conventional four-chain antibody (such as, without limitation, a $V_H$ sequence that is derived from a human antibody) or be a so-called $V_{HH}$-sequence (as defined herein) that is derived from a so-called "heavy chain antibody" (as defined herein).

However, it should be noted that the polypeptides of the invention are not limited by the origin of the amino acid sequence (or of the nucleotide sequence of the invention used to express it), nor as to the way that the amino acid sequence or nucleotide sequence is (or has been) generated or obtained. Thus, such an amino acid sequences may be naturally occurring amino acid sequences (from any suitable species) or synthetic or semi-synthetic amino acid sequences. In a specific but non-limiting aspect of the invention, the amino acid sequence is a naturally occurring immunoglobulin sequence (from any suitable species) or a synthetic or semi-synthetic immunoglobulin sequence, including but not limited to "humanized" (as defined herein) immunoglobulin sequences (such as partially or fully humanized mouse or rabbit immunoglobulin sequences, and in particular partially or fully humanized $V_{HH}$ sequences or Nanobodies), "camelized" (as defined herein) immunoglobulin sequences, as well as immunoglobulin sequences that have been obtained by techniques such as affinity maturation (for example, starting from synthetic, random or naturally occurring immunoglobulin sequences), CDR grafting, veneering, combining fragments derived from different immunoglobulin sequences, PCR assembly using overlapping primers, and similar techniques for engineering immunoglobulin sequences well known to the skilled person; or any suitable combination of any of the foregoing. Reference is for example made to the standard handbooks, as well as to the further description and prior art mentioned herein.

Similarly, the nucleotide sequence that makes up the nucleotide sequences encoding the polypeptides of the invention may be naturally occurring nucleotide sequences or synthetic or semi-synthetic sequences, and may for example be sequences that are isolated by PCR from a suitable naturally occurring template (e.g. DNA or RNA isolated from a cell), nucleotide sequences that have been isolated from a library (and in particular, an expression library), nucleotide sequences that have been prepared by introducing mutations into a naturally occurring nucleotide sequence (using any suitable technique known per se, such as mismatch PCR), nucleotide sequence that have been prepared by PCR using overlapping primers, or nucleotide sequences that have been prepared using techniques for DNA synthesis known per se.

The amino acid sequence that forms (i.e. is comprised in, is encompassed in, is used to generate and/or make up) the biparatopic (or multiparatopic) polypeptides of the invention may in particular be a domain antibody (or an amino acid sequence that is suitable for use as a domain antibody), a single domain antibody (or an amino acid sequence that is suitable for use as a single domain antibody), a "dAb" (or an amino acid sequence that is suitable for use as a dAb) or a Nanobody (as defined herein, and including but not limited to a $V_{HH}$ sequence); other single variable domains, or any suitable fragment of any one thereof. For a general description of (single) domain antibodies, reference is also made to the prior art cited above, as well as to EP 0 368 684. For the term "dAb's", reference is for example made to Ward et al. (Nature 1989 Oct. 12; 341 (6242): 544-6), to Holt et al., Trends Biotechnol., 2003, 21(11):484-490; as well as to for example WO 06/030220, WO 06/003388 and other published patent applications of Domantis Ltd. It should also be noted that, although less preferred in the context of the present invention because they are not of mammalian origin, single domain antibodies or single variable domains can be derived from certain species of shark (for example, the so-called "IgNAR domains", see for example WO 05/18629).

In particular, the amino acid sequence of the invention may be a Nanobody® (as defined herein) or a suitable fragment thereof. [Note: Nanobody®, Nanobodies® and Nanoclone® are registered trademarks of Ablynx N.V.]

For a general description of Nanobodies, reference is made to the further description below, as well as to the prior art cited herein. In this respect, it should however be noted that this description and the prior art mainly described Nanobodies of the so-called "$V_H3$ class" (i.e. Nanobodies with a high degree of sequence homology to human germline sequences of the $V_H3$ class such as DP-47, DP-51 or DP-29). It should however be noted that the polypeptides of the invention in the broadest sense generally may encompass any type of Nanobody directed against IL-6R, and for example also may encompass the Nanobodies belonging to the so-called "$V_H4$ class" (i.e. Nanobodies with a high degree of sequence homology to human germline sequences of the $V_H4$ class such as DP-78), as for example described in WO 07/118,670.

Generally, Nanobodies (in particular $V_{HH}$ sequences and partially humanized Nanobodies) can in particular be characterized by the presence of one or more "Hallmark residues" (as described herein) in one or more of the framework sequences (again as further described herein).

Thus, generally, a Nanobody can be defined as an amino acid sequence with the (general) structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which one or more of the Hallmark residues are as further defined herein.

In particular, a Nanobody can be an amino acid sequence with the (general) structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which the framework sequences are as further defined herein.

More in particular, a Nanobody can be an amino acid sequence with the (general) structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which:
i) preferably one or more of the amino acid residues at positions 11, 37, 44, 45, 47, 83, 84, 103, 104 and 108 according to the Kabat numbering are chosen from the Hallmark residues mentioned in Table B-2 below; and in which:
ii) said amino acid sequence has at least 80% amino acid identity with at least one of the amino acid sequences of HQ ID NO's: 1 to 22, in which for the purposes of determining the degree of amino acid identity, the amino acid residues that form the CDR sequences (indicated with X in the sequences of HQ ID NO's: 1 to 22) are disregarded.

In a non-limiting aspect of the invention, the amino acid sequences and/or Nanobodies that form (i.e. are comprised in, are encompassed in, are used to generate and/or make up) the biparatopic (or multiparatopic) polypeptides of the invention, comprise CDR sequences that are generally as further defined herein (these amino acid sequences and/or Nanobodies are also encompassed in the present invention and are also referred to as "amino acid sequences of the invention" and "Nanobodies of the invention").

Thus, the invention also relates to such amino acid sequences and/or Nanobodies that can bind to (as defined herein) and/or are directed against IL-6R and that comprise CDR sequences that are generally as further defined herein, to suitable fragments thereof, as well as to polypeptides that comprise or essentially consist of one or more of such Nanobodies and/or suitable fragments. In a preferred aspect, the invention relates to Nanobodies with SEQ ID NO's: 132 to 232 (see Tables A-1 and A-3).

In particular, the invention in some specific aspects provides:
amino acid sequences that are directed against (as defined herein) IL-6R and that have at least 80%, preferably at least 85%, such as 90% or 95% or more sequence identity with at least one of the amino acid sequences of SEQ ID NO's: 132-216 (see Table A-3);
amino acid sequences that cross-block (as defined herein) the binding of at least one of the amino acid sequences of SEQ ID NO's: 132-216 (see Table A-3) to IL-6R and/or that compete with at least one of the amino acid sequences of SEQ ID NO's: 132-216 (see Table A-3) for binding to IL-6R;
which amino acid sequences may be as further described herein (and may for example be Nanobodies); as well as polypeptides of the invention that comprise one or more of such amino acid sequences (which may be as further described herein), and particularly biparatopic (or multiparatopic) polypeptides as described herein, and nucleic acid sequences that encode such amino acid sequences and polypeptides. Such amino acid sequences and polypeptides do not include any naturally occurring ligands.

Accordingly, some particularly preferred Nanobodies of the invention are Nanobodies which can bind (as further defined herein) to and/or are directed against to IL-6R and which:
i) have at least 80% amino acid identity with at least one of the amino acid sequences of SEQ ID NO's: 132-216 (see Table A-3), in which for the purposes of determining the degree of amino acid identity, the amino acid residues that form the CDR sequences are disregarded. In this respect, reference is also made to Table A-1, which lists the framework 1 sequences (SEQ ID NO's: 233-317), framework 2 sequences (SEQ ID NO's: 403-487), framework 3 sequences (SEQ ID NO's: 573-657) and framework 4 sequences (SEQ ID NO's: 743-827) of the Nanobodies of SEQ ID NO's: 132-216 (see Table A-3) (with respect to the amino acid residues at positions 1 to 4 and 27 to 30 of the framework 1 sequences, reference is also made to the comments made below. Thus, for determining the degree of amino acid identity, these residues are preferably disregarded);
and in which:
ii) preferably one or more of the amino acid residues at positions 11, 37, 44, 45, 47, 83, 84, 103, 104 and 108 according to the Kabat numbering are chosen from the Hallmark residues mentioned in Table B-2 below.

In these Nanobodies, the CDR sequences are generally as further defined herein.

Again, such Nanobodies may be derived in any suitable manner and from any suitable source, and may for example be naturally occurring $V_{HH}$ sequences (i.e. from a suitable species of Camelid) or synthetic or semi-synthetic amino acid sequences, including but not limited to "humanized" (as defined herein) Nanobodies, "camelized" (as defined herein) immunoglobulin sequences (and in particular camelized heavy chain variable domain sequences), as well as Nanobodies that have been obtained by techniques such as affinity maturation (for example, starting from synthetic, random or naturally occurring immunoglobulin sequences), CDR grafting, veneering, combining fragments derived from different immunoglobulin sequences, PCR assembly using overlapping primers, and similar techniques for engineering immunoglobulin sequences well known to the skilled person; or any suitable combination of any of the foregoing as further described herein. Also, when a Nanobody comprises a $V_{HH}$ sequence, said Nanobody may be suitably humanized, as further described herein, so as to provide one or more further (partially or fully) humanized Nanobodies of the invention. Similarly, when a Nanobody comprises a synthetic or semi-synthetic sequence (such as a partially humanized sequence), said Nanobody may optionally be further suitably humanized, again as described herein, again so as to provide one or more further (partially or fully) humanized Nanobodies of the invention.

In particular, humanized Nanobodies may be amino acid sequences that are as generally defined for Nanobodies in the previous paragraphs, but in which at least one amino acid residue is present (and in particular, in at least one of the framework residues) that is and/or that corresponds to a humanizing substitution (as defined herein). Some preferred, but non-limiting humanizing substitutions (and suitable combinations thereof) will become clear to the skilled person based on the disclosure herein. In addition, or alternatively, other potentially useful humanizing substitutions can be ascertained by comparing the sequence of the framework regions of a naturally occurring $V_{HH}$ sequence with the corresponding framework sequence of one or more closely related human $V_H$ sequences, after which one or more of the potentially useful humanizing substitutions (or combinations thereof) thus determined can be introduced into said $V_{HH}$ sequence (in any manner known per se, as further described herein) and the resulting humanized $V_{HH}$ sequences can be tested for affinity for the target, for stability, for ease and level of expression, and/or for other desired properties. In this way, by means of a limited degree of trial and error, other suitable humanizing substitutions (or suitable combinations thereof) can be determined by the skilled person based on the disclosure herein. Also, based on the foregoing, (the framework regions of) a Nanobody may be partially humanized or fully humanized.

Some particularly preferred humanized Nanobodies of the invention are humanized variants of the Nanobodies of SEQ ID NO's: 132-216 (see Table A-3).

Thus, some other preferred Nanobodies of the invention are Nanobodies which can bind (as further defined herein) to IL-6R and which:

i) are a humanized variant of one of the amino acid sequences of SEQ ID NO's: 132-216 (see Table A-3); and/or ii) have at least 80% amino acid identity with at least one of the amino acid sequences of SEQ ID NO's: 132-216 (see Table A-3), in which for the purposes of determining the degree of amino acid identity, the amino acid residues that form the CDR sequences are disregarded;

and in which:

i) preferably one or more of the amino acid residues at positions 11, 37, 44, 45, 47, 83, 84, 103, 104 and 108 according to the Kabat numbering are chosen from the Hallmark residues mentioned in Table 8-2 below.

For binding to IL-6R, an amino acid sequence or Nanobody of the invention will usually contain within its amino acid sequence one or more amino acid residues or one or more stretches of amino acid residues (i.e. with each "stretch" comprising two or amino acid residues that are adjacent to each other or in close proximity to each other, i.e. in the primary or tertiary structure of the amino acid sequence) via which the amino acid sequence or Nanobody of the invention can bind to IL-6R, which amino acid residues or stretches of amino acid residues thus form the "site" for binding to IL-6R (also referred to herein as the "antigen binding site").

According to another specific aspect of the invention, the invention provides a number of stretches of amino acid residues (i.e. small peptides) that are particularly suited for binding to IL-6R. These stretches of amino acid residues may be present in, and/or may be incorporated into, an amino acid sequence of the invention, in particular in such a way that they form (part of) the antigen binding site of an amino acid sequence of the invention. As these stretches of amino acid residues were first generated as CDR sequences of heavy chain antibodies or $V_{HH}$ sequences that were raised against IL-6R (or may be based on and/or derived from such CDR sequences, as further described herein), they will also generally be referred to herein as "CDR sequences" (i.e. as CDR1 sequences, CDR2 sequences and CDR3 sequences, respectively). It should however be noted that the invention in its broadest sense is not limited to a specific structural role or function that these stretches of amino acid residues may have in an amino acid sequence of the invention, as long as these stretches of amino acid residues allow the amino acid sequence of the invention to bind to IL-6R. Thus, generally, the invention in its broadest sense comprises any amino acid sequence that is capable of binding to IL-6R and that comprises one or more CDR sequences as described herein, and in particular a suitable combination of two or more such CDR sequences, that are suitably linked to each other via one or more further amino acid sequences, such that the entire amino acid sequence forms a binding domain and/or binding unit that is capable of binding to IL-6R. It should however also be noted that the presence of only one such CDR sequence in an amino acid sequence of the invention may by itself already be sufficient to provide an amino acid sequence of the invention that is capable of binding to IL-6R; reference is for example again made to the so-called "Expedite fragments" described in WO 03/050531.

Thus, in another specific, but non-limiting aspect, the amino acid sequence of the invention may be an amino acid sequence that comprises at least one amino acid sequence that is chosen from the group consisting of the CDR1 sequences, CDR2 sequences and CDR3 sequences that are described herein (or any suitable combination thereof). In particular, an amino acid sequence of the invention may be an amino acid sequence that comprises at least one antigen binding site, wherein said antigen binding site comprises at least one amino acid sequence that is chosen from the group consisting of the CDR1 sequences, CDR2 sequences and CDR3 sequences that are described herein (or any suitable combination thereof).

Generally, in this aspect of the invention, the amino acid sequence of the invention may be any amino acid sequence that comprises at least one stretch of amino acid residues, in which said stretch of amino acid residues has an amino acid sequence that corresponds to the sequence of at least one of the CDR sequences described herein. Such an amino acid sequence may or may not comprise an immunoglobulin fold. For example, and without limitation, such an amino acid sequence may be a suitable fragment of an immunoglobulin sequence that comprises at least one such CDR sequence, but that is not large enough to form a (complete) immunoglobulin fold (reference is for example again made to the "Expedite fragments" described in WO 03/050531). Alternatively, such an amino acid sequence may be a suitable "protein scaffold" that comprises least one stretch of amino acid residues that corresponds to such a CDR sequence (i.e. as part of its antigen binding site). Suitable scaffolds for presenting amino acid sequences will be clear to the skilled person, and for example comprise, without limitation, to binding scaffolds based on or derived from immunoglobulins (i.e. other than the immunoglobulin sequences already described herein), protein scaffolds derived from protein A domains (such as Affibodies™), tendamistat, fibronectin, lipocalin, CTLA-4, T-cell receptors, designed ankyrin repeats, avimers and PDZ domains (Binz et al., Nat. Biotech 2005, Vol 23:1257), and binding moieties based on DNA or RNA including but not limited to DNA or RNA aptamers (Ulrich et al., Comb Chem High Throughput Screen 2006 9(8):619-32).

Again, any amino acid sequence of the invention that comprises one or more of these CDR sequences is preferably such that it can specifically bind (as defined herein) to IL-6R, and more in particular such that it can bind to IL-6R with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein), that is as defined herein.

More in particular, the amino acid sequences and/or Nanobodies of the invention should preferably bind to IL-6R with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein.

In particular, amino acid sequences and/or Nanobodies of the invention are preferably such that they:

bind to IL-6R with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles);

and/or such that they:

bind to IL-6R with a $k_{on}$-rate of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$;

and/or such that they:

bind to IL-6R with a $k_{off}$-rate between 1 $s^{-1}$ ($t_{1/2}$=0.69 s) and $10^{-6}$ $s^{-1}$ (providing a near irreversible complex with a $t_{1/2}$ of multiple days), preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Preferably, a monovalent amino acid sequence of the invention (or a polypeptide that contains only one amino acid sequence of the invention) is preferably such that it will bind to IL-6R with an affinity less than 500 nM, preferably less than 200 nM, more preferably less than 10 nM, such as less than 500 μM.

Some preferred IC50 values for binding of the amino acid sequences, Nanobodies and/or polypeptides of the invention to IL-6R will become clear from the further description and examples herein.

More in particular, the amino acid sequences according to this aspect of the invention may be any amino acid sequence that comprises at least one antigen binding site, wherein said antigen binding site comprises at least two amino acid sequences that are chosen from the group consisting of the CDR1 sequences described herein, the CDR2 sequences described herein and the CDR3 sequences described herein, such that (i) when the first amino acid sequence is chosen from the CDR1 sequences described herein, the second amino acid sequence is chosen from the CDR2 sequences described herein or the CDR3 sequences described herein; (ii) when the first amino acid sequence is chosen from the CDR2 sequences described herein, the second amino acid sequence is chosen from the CDR1 sequences described herein or the CDR3 sequences described herein; or (iii) when the first amino acid sequence is chosen from the CDR3 sequences described herein, the second amino acid sequence is chosen from the CDR1 sequences described herein or the CDR3 sequences described herein.

Even more in particular, the amino acid sequences of the invention may be amino acid sequences that comprise at least one antigen binding site, wherein said antigen binding site comprises at least three amino acid sequences that are chosen from the group consisting of the CDR1 sequences described herein, the CDR2 sequences described herein and the CDR3 sequences described herein, such that the first amino acid sequence is chosen from the CDR1 sequences described herein, the second amino acid sequence is chosen from the CDR2 sequences described herein, and the third amino acid sequence is chosen from the CDR3 sequences described herein. Preferred combinations of CDR1, CDR2 and CDR3 sequences will become clear from the further description herein. As will be clear to the skilled person, such an amino acid sequence is preferably an immunoglobulin sequence (as further described herein), but it may for example also be any other amino acid sequence that comprises a suitable scaffold for presenting said CDR sequences.

Thus, in one specific, but non-limiting aspect, the invention relates to an amino acid sequence directed against IL-6R, that comprises one or more stretches of amino acid residues chosen from the group consisting of:

a) the amino acid sequences of SEQ ID NO's: 302-386;
b) amino acid sequences that have at least 80% amino acid identity with at least one of the amino acid sequences of SEQ ID NO's: 302-386;
c) amino acid sequences that have 3, 2, or 1 amino acid difference with at least one of the amino acid sequences of SEQ ID NO's: 302-386;
d) the amino acid sequences of SEQ ID NO's: 472-556;
e) amino acid sequences that have at least 80% amino acid identity with at least one of the amino acid sequences of SEQ ID NO's: 472-556;
f) amino acid sequences that have 3, 2, or 1 amino acid difference with at least one of the amino acid sequences of SEQ ID NO's: 472-556;
g) the amino acid sequences of SEQ ID NO's: 642-726;
h) amino acid sequences that have at least 80% amino acid identity with at least one of the amino acid sequences of SEQ ID NO's: 542-726;
i) amino acid sequences that have 3, 2, or 1 amino acid difference with at least one of the amino acid sequences of SEQ ID NO's: 642-726;
or any suitable combination thereof.

When an amino acid sequence of the invention contains one or more amino acid sequences according to b) and/or c):

i) any amino acid substitution in such an amino acid sequence according to b) and/or c) is preferably, and compared to the corresponding amino acid sequence according to a), a conservative amino acid substitution, (as defined herein);

and/or ii) the amino acid sequence according to b) and/or c) preferably only contains amino acid substitutions, and no amino acid deletions or insertions, compared to the corresponding amino acid sequence according to a);

and/or iii) the amino acid sequence according to b) and/or c) may be an amino acid sequence that is derived from an amino acid sequence according to a) by means of affinity maturation using one or more techniques of affinity maturation known per se.

Similarly, when an amino acid sequence of the invention contains one or more amino acid sequences according to e) and/or f):

i) any amino acid substitution in such an amino acid sequence according to e) and/or f) is preferably, and compared to the corresponding amino acid sequence according to d), a conservative amino acid substitution, (as defined herein);
and/or
ii) the amino acid sequence according to e) and/or f) preferably only contains amino acid substitutions, and no amino acid deletions or insertions, compared to the corresponding amino acid sequence according to d);
and/or
iii) the amino acid sequence according to e) and/or f) may be an amino acid sequence that is derived from an amino acid sequence according to d) by means of affinity maturation using one or more techniques of affinity maturation known per se.

Also, similarly, when an amino acid sequence of the invention contains one or more amino acid sequences according to h) and/or i):
i) any amino acid substitution in such an amino acid sequence according to h) and/or i) is preferably, and compared to the corresponding amino acid sequence according to g), a conservative amino acid substitution, (as defined herein);
and/or
ii) the amino acid sequence according to h) and/or i) preferably only contains amino acid substitutions, and no amino acid deletions or insertions, compared to the corresponding amino acid sequence according to g);
and/or
iii) the amino acid sequence according to h) and/or i) may be an amino acid sequence that is derived from an amino acid sequence according to g) by means of affinity maturation using one or more techniques of affinity maturation known per se.

It should be understood that the last preceding paragraphs also generally apply to any amino acid sequences of the invention that comprise one or more amino acid sequences according to b), c), e), f), h) or i), respectively.

In this specific aspect, the amino acid sequence preferably comprises one or more stretches of amino acid residues chosen from the group consisting of:
i) the amino acid sequences of SEQ ID NO's: 302-386;
ii) the amino acid sequences of SEQ ID NO's: 472-556; and
iii) the amino acid sequences of SEQ ID NO's: 642-726;
or any suitable combination thereof.

Also, preferably, in such an amino acid sequence, at least one of said stretches of amino acid residues forms part of the antigen binding site for binding against IL-6R.

In a more specific, but again non-limiting aspect, the invention relates to an amino acid sequence directed against IL-6R, that comprises two or more stretches of amino acid residues chosen from the group consisting of:
a) the amino acid sequences of SEQ ID NO's: 302-386;
b) amino acid sequences that have at least 80% amino acid identity with at least one of the amino acid sequences of SEQ ID NO's: 302-386;
c) amino acid sequences that have 3, 2, or 1 amino acid difference with at least one of the amino acid sequences of SEQ ID NO's: 302-386;
d) the amino acid sequences of SEQ ID NO's: 472-556;
e) amino acid sequences that have at least 80% amino acid identity with at least one of the amino acid sequences of SEQ ID NO's: 472-556;
f) amino acid sequences that have 3, 2, or 1 amino acid difference with at least one of the amino acid sequences of SEQ ID NO's: 472-556;
g) the amino acid sequences of SEQ ID NO's: 642-726;
h) amino acid sequences that have at least 80% amino acid identity with at least one of the amino acid sequences of SEQ ID NO's: 642-726;
i) amino acid sequences that have 3, 2, or 1 amino acid difference with at least one of the amino acid sequences of SEQ ID NO's: 642-726;
such that (i) when the first stretch of amino acid residues corresponds to one of the amino acid sequences according to a), b) or c), the second stretch of amino acid residues corresponds to one of the amino acid sequences according to d), e), f), g), h) or i); (ii) when the first stretch of amino acid residues corresponds to one of the amino acid sequences according to d), e) or f), the second stretch of amino acid residues corresponds to one of the amino acid sequences according to a), b), c), g), h) or i); or (iii) when the first stretch of amino acid residues corresponds to one of the amino acid sequences according to g), h) or i), the second stretch of amino acid residues corresponds to one of the amino acid sequences according to a), b), c), d), e) or f).

In this specific aspect, the amino acid sequence preferably comprises two or more stretches of amino acid residues chosen from the group consisting of:
i) the amino acid sequences of SEQ ID NO's: 302-386;
ii) the amino acid sequences of SEQ ID NO's: 472-556; and
iii) the amino acid sequences of SEQ ID NO's: 642-726;
such that, (i) when the first stretch of amino acid residues corresponds to one of the amino acid sequences of SEQ ID NO's: 302-386, the second stretch of amino acid residues corresponds to one of the amino acid sequences of SEQ ID NO's: 472-556 or of SEQ ID NO's: 642-726; (ii) when the first stretch of amino acid residues corresponds to one of the amino acid sequences of SEQ ID NO's: 472-556, the second stretch of amino acid residues corresponds to one of the amino acid sequences of SEQ ID NO's: 302-386 or of SEQ ID NO's: 642-726; or (iii) when the first stretch of amino acid residues corresponds to one of the amino acid sequences of SEQ ID NO's: 642-726, the second stretch of amino acid residues corresponds to one of the amino acid sequences of SEQ ID NO's: 302-386 or of SEQ ID NO's: 472-556.

Also, in such an amino acid sequence, the at least two stretches of amino acid residues again preferably form part of the antigen binding site for binding against IL-6R.

In an even more specific, but non-limiting aspect, the invention relates to an amino acid sequence directed against IL-6R, that comprises three or more stretches of amino acid residues, in which the first stretch of amino acid residues is chosen from the group consisting of:
a) the amino acid sequences of SEQ ID NO's: 302-386;
b) amino acid sequences that have at least 80% amino acid identity with at least one of the amino acid sequences of SEQ ID NO's: 302-386;
c) amino acid sequences that have 3, 2, or 1 amino acid difference with at least one of the amino acid sequences of SEQ ID NO's: 302-386; the second stretch of amino acid residues is chosen from the group consisting of:
d) the amino acid sequences of SEQ ID NO's: 472-556;
e) amino acid sequences that have at least 80% amino acid identity with at least one of the amino acid sequences of SEQ ID NO's: 472-556;
f) amino acid sequences that have 3, 2, or 1 amino acid difference with at least one of the amino acid sequences of SEQ ID NO's: 472-556;
and the third stretch of amino acid residues is chosen from the group consisting of:
g) the amino acid sequences of SEQ ID NO's: 642-726;

h) amino acid sequences that have at least 80% amino acid identity with at least one of the amino acid sequences of SEQ ID NO's: 642-726;

i) amino acid sequences that have 3, 2, or 1 amino acid difference with at least one of the amino acid sequences of SEQ ID NO's: 642-726.

Preferably, in this specific aspect, the first stretch of amino acid residues is chosen from the group consisting of the amino acid sequences of SEQ ID NO's: 302-386; the second stretch of amino acid residues is chosen from the group consisting of the amino acid sequences of SEQ ID NO's: 472-556; and the third stretch of amino acid residues is chosen from the group consisting of the amino acid sequences of SEQ ID NO's: 642-726.

Again, preferably, in such an amino acid sequence, the at least three stretches of amino acid residues forms part of the antigen binding site for binding against IL-6R.

Preferred combinations of such stretches of amino acid sequences will become clear from the further disclosure herein.

Preferably, in such amino acid sequences the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 132-216 (see Table A-1). This degree of amino acid identity can for example be determined by determining the degree of amino acid identity (in a manner described herein) between said amino acid sequence and one or more of the sequences of SEQ ID NO's: 132-216 (see Table A-3), in which the amino acid residues that form the framework regions are disregarded. Also, such amino acid sequences of the invention can be as further described herein.

Also, such amino acid sequences are preferably such that they can specifically bind (as defined herein) to IL-6R; and more in particular bind to IL-6R with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein.

When the amino acid sequence of the invention essentially consists of 4 framework regions (FR1 to FR4, respectively) and 3 complementarity determining regions (CDR1 to CDR3, respectively), the amino acid sequence of the invention is preferably such that:

CDR1 is chosen from the group consisting of:
a) the amino acid sequences of SEQ ID NO's: 302-386;
b) amino acid sequences that have at least 80% amino acid identity with at least one of the amino acid sequences of SEQ ID NO's: 302-386;
c) amino acid sequences that have 3, 2, or 1 amino acid difference with at least one of the amino acid sequences of SEQ ID NO's: 302-386;
and/or
CDR2 is chosen from the group consisting of:
d) the amino acid sequences of SEQ ID NO's: 472-556;
e) amino acid sequences that have at least 80% amino acid identity with at least one of the amino acid sequences of SEQ ID NO's: 472-556;
f) amino acid sequences that have 3, 2, or 1 amino acid difference with at least one of the amino acid sequences of SEQ ID NO's: 472-556;
and/or
CDR3 is chosen from the group consisting of:
g) the amino acid sequences of SEQ ID NO's: 642-726;
h) amino acid sequences that have at least 80% amino acid identity with at least one of the amino acid sequences of SEQ ID NO's: 642-726;
i) amino acid sequences that have 3, 2, or 1 amino acid difference with at least one of the amino acid sequences of SEQ ID NO's: 642-726.

In particular, such an amino acid sequence of the invention may be such that CDR1 is chosen from the group consisting of the amino acid sequences of SEQ ID NO's: 302-386; and/or CDR2 is chosen from the group consisting of the amino acid sequences of SEQ ID NO's: 472-556; and/or CDR3 is chosen from the group consisting of the amino acid sequences of SEQ ID NO's: 642-726.

In particular, when the amino acid sequence of the invention essentially consists of 4 framework regions (FR1 to FR4, respectively) and 3 complementarity determining regions (CDR1 to CDR3, respectively), the amino acid sequence of the invention is preferably such that:

CDR1 is chosen from the group consisting of:
a) the amino acid sequences of SEQ ID NO's: 302-386;
b) amino acid sequences that have at least 80% amino acid identity with at least one of the amino acid sequences of SEQ ID NO's: 302-386;
c) amino acid sequences that have 3, 2, or 1 amino acid difference with at least one of the amino acid sequences of SEQ ID NO's: 302-386;
and
CDR2 is chosen from the group consisting of:
d) the amino acid sequences of SEQ ID NO's: 472-556;
e) amino acid sequences that have at least 80% amino acid identity with at least one of the amino acid sequences of SEQ ID NO's: 472-556;
f) amino acid sequences that have 3, 2, or 1 amino acid difference with at least one of the amino acid sequences of SEQ ID NO's: 472-556;
and
CDR3 is chosen from the group consisting of:
g) the amino acid sequences of SEQ ID NO's: 642-726;
h) amino acid sequences that have at least 80% amino acid identity with at least one of the amino acid sequences of SEQ ID NO's: 642-726;
i) amino acid sequences that have 3, 2, or 1 amino acid difference with at least one of the amino acid sequences of SEQ ID NO's: 642-726; or any suitable fragment of such an amino acid sequence In particular, such an amino acid sequence of the invention may be such that CDR1 is chosen from the group consisting of the amino acid sequences of SEQ ID NO's: 302-386; and CDR2 is chosen from the group consisting of the amino acid sequences of SEQ ID NO's: 472-556; and CDR3 is chosen from the group consisting of the amino acid sequences of SEQ ID NO's: 642-726, Again, preferred combinations of CDR sequences will become clear from the further description herein.

Also, such amino acid sequences are preferably such that they can specifically bind (as defined herein) to IL-6R; and more in particular bind to IL-6R with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein.

In one preferred, but non-limiting aspect, the invention relates to an amino acid sequence that essentially consists of 4 framework regions (FR1 to FR4, respectively) and 3 complementarity determining regions (CDR1 to CDR3, respectively), in which the CDR sequences of said amino acid sequence have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 132-216 (see Table A-1). This degree of amino acid identity can for example be determined by determining the degree of amino acid identity (in a manner described herein) between said amino acid sequence and one or more of the sequences of SEQ ID NO's: 132-216 (see Table A-3), in which the amino acid residues that form the framework regions are disregarded. Such amino acid sequences of the invention can be as further described herein.

In such an amino acid sequence of the invention, the framework sequences may be any suitable framework sequences, and examples of suitable framework sequences will be clear to the skilled person, for example on the basis the standard handbooks and the further disclosure and prior art mentioned herein.

The framework sequences are preferably (a suitable combination of) immunoglobulin framework sequences or framework sequences that have been derived from immunoglobulin framework sequences (for example, by humanization or camelization). For example, the framework sequences may be framework sequences derived from a light chain variable domain (e.g. a sequence) and/or from a heavy chain variable domain (e.g. a $V_u$-sequence). In one particularly preferred aspect, the framework sequences are either framework sequences that have been derived from a $V_{HH}$ sequence (in which said framework sequences may optionally have been partially or fully humanized) or are conventional $V_H$ sequences that have been camelized (as defined herein).

The framework sequences are preferably such that the amino acid sequence of the invention is a domain antibody (or an amino acid sequence that is suitable for use as a domain antibody); is a single domain antibody (or an amino acid sequence that is suitable for use as a single domain antibody); is a "dAb" (or an amino acid sequence that is suitable for use as a dAb); or is a Nanobody (including but not limited to $V_{HH}$, sequence). Again, suitable framework sequences will be clear to the skilled person, for example on the basis the standard handbooks and the further disclosure and prior art mentioned herein.

In particular, the framework sequences present in the amino acid sequences of the invention may contain one or more of Hallmark residues (as defined herein), such that the amino acid sequence of the invention is a Nanobody (also referred to as "Nanobody of the invention"). Some preferred, but non-limiting examples of (suitable combinations of) such framework sequences will become clear from the further disclosure herein.

For a general description of heavy chain antibodies and the variable domains thereof, reference is inter alia made to the prior art cited herein, as well as to the prior art mentioned on page 59 of WO 08/020,079 and to the list of references mentioned on pages 41-43 of the International application WO 06/040153, which prior art and references are incorporated herein by reference.

In accordance with the terminology used in the art (see the above references), the variable domains present in naturally occurring heavy chain antibodies will also be referred to as "$V_{HH}$ domains", in order to distinguish them from the heavy chain variable domains that are present in conventional 4-chain antibodies (which will be referred to hereinbelow as "$V_H$ domains") and from the light chain variable domains that are present in conventional 4-chain antibodies (which will be referred to hereinbelow as "$V_L$ domains").

As mentioned in the prior art referred to above, $V_{HH}$ domains have a number of unique structural characteristics and functional properties which make isolated $V_{HH}$ domains (as well as Nanobodies based thereon, which share these structural characteristics and functional properties with the naturally occurring $V_{HH}$ domains) and proteins containing the same highly advantageous for use as functional antigen-binding domains or proteins. In particular, and without being limited thereto, $V_{HH}$ domains (which have been "designed" by nature to functionally bind to an antigen without the presence of, and without any interaction with, a light chain variable domain) and Nanobodies can function as a single, relatively small, functional antigen-binding structural unit, domain or protein. This distinguishes the $V_{HH}$ domains from the $V_H$ and V, domains of conventional 4-chain antibodies, which by themselves are generally not suited for practical application as single antigen-binding proteins or domains, but need to be combined in some form or another to provide a functional antigen-binding unit (as in for example conventional antibody fragments such as Fab fragments; in ScFv's fragments, which consist of a $V_H$ domain covalently linked to a $V_L$ domain).

Because of these unique properties, the use of $V_{HH}$ domains and Nanobodies as single antigen-binding proteins or as antigen-binding domains (i.e. as part of a larger protein or polypeptide) offers a number of significant advantages over the use of conventional $V_H$ and $V_L$ domains, scFv's or conventional antibody fragments (such as Fab- or F(ab')$_2$-fragments), including the advantages that are listed on pages 60 and 61 of WO 08/020,079.

In one aspect, the invention provides Nanobodies against IL-6R, and in particular Nanobodies against IL-6R from a warm-blooded animal, and more in particular Nanobodies against IL-6R from a mammal, and especially Nanobodies against human IL-6R; as well as proteins and/or polypeptides comprising at least one such Nanobody.

In particular, the invention provides Nanobodies against IL-6R, and proteins and/or polypeptides comprising the same, as well as biparatopic (or multiparatopic) polypeptides, that have improved therapeutic and/or pharmacological properties and/or other advantageous properties (such as, for example, improved ease of preparation and/or reduced costs of goods), compared to conventional antibodies against IL-6R or fragments thereof, compared to constructs that could be based on such conventional antibodies or antibody fragments (such as Fab' fragments, F(ab')$_2$ fragments, ScFv constructs, "diabodies" and other multispecific constructs (see for example the review by Holliger and Hudson, Nat. Biotechnol. 2005 September; 23(9):1126-36)), and also compared to the so-called "dAb's" or similar (single) domain antibodies that may be derived from variable domains of conventional antibodies. These improved and advantageous properties will become clear from the further description herein, and for example include, without limitation, one or more of:

increased affinity and/or avidity for IL-6R, either in a monovalent format, in a multivalent format (for example in a bivalent format), in a multiparatopic format (for example in a biparatopic format) and/or in a multispecific format (for example one of the multi-specific formats described hereinbelow);

better suitability for formatting in a multivalent format (for example in a bivalent format);

better suitability for formatting in a multiparatopic format (for example one of the multiparatopic formats described hereinbelow);

better suitability for formatting in a multispecific format (for example one of the multispecific formats described hereinbelow);

improved suitability or susceptibility for "humanizing" substitutions (as defined herein);

less immunogenicity, either in a monovalent format, in a multivalent format (for example in a bivalent format), in multiparatopic format (for example in a biparatopic format) and/or in a multispecific format (for example one of the multispecific formats described hereinbelow);

increased stability, either in a monovalent format, in a multivalent format (for example in a bivalent format), in multiparatopic format (for example in a biparatopic format) and/or in a multispecific format (for example one of the multispecific formats described hereinbelow);

increased specificity towards IL-6R, either in a monovalent format, in a multivalent format (for example in a bivalent format), in multiparatopic format (for example in a biparatopic format) and/or in a multispecific format (for example one of the multispecific formats described hereinbelow);

decreased or where desired increased cross-reactivity with IL-6R from different species;

and/or one or more other improved properties desirable for pharmaceutical use (including prophylactic use and/or therapeutic use) and/or for diagnostic use (including but not limited to use for imaging purposes), either in a monovalent format, in a multivalent format (for example in a bivalent format), in multiparatopic format (for example in a biparatopic format) and/or in a multispecific format (for example one of the multispecific formats described hereinbelow).

As generally described herein for the amino acid sequences of the invention, the Nanobodies of the invention are preferably in essentially isolated form (as defined herein), or form part of a protein or polypeptide of the invention (as defined herein), which may comprise or essentially consist of one or more Nanobodies of the invention and which may optionally further comprise one or more further amino acid sequences (all optionally linked via one or more suitable linkers). For example, and without limitation, the one or more amino acid sequences of the invention may be used as a binding unit in such a protein or polypeptide, which may optionally contain one or more further amino acid sequences that can serve as a binding unit (i.e. against one or more other targets than IL-6R), so as to provide a monovalent, multivalent, multiparatopic or multispecific polypeptide of the invention, respectively, all as described herein. In particular, such a protein or polypeptide may comprise or essentially consist of one or more Nanobodies of the invention and optionally one or more (other) Nanobodies (i.e. directed against the same or other targets than IL-6R), all optionally linked via one or more suitable linkers, so as to provide a monovalent, multivalent, multiparatopic or multispecific Nanobody construct, respectively, as further described herein. Such proteins or polypeptides may also be in essentially isolated form (as defined herein).

As already described herein, the amino acid sequence and structure of a Nanobody can be considered—without however being limited thereto—to be comprised of four framework regions or "FR's" (or sometimes also referred to as "FW's"), which are referred to in the art and herein as "Framework region 1" or "FR1"; as "Framework region 2" or "FR2"; as "Framework region 3" or "FR3"; and as "Framework region 4" or "FR4", respectively; which framework regions are interrupted by three complementary determining regions or "CDR's", which are referred to in the art as "Complementarity Determining Region 1" or "CDR1"; as "Complementarity Determining Region 2" or "CDR2"; and as "Complementarity Determining Region 3" or "CDR3", respectively. Some preferred framework sequences and CDR's (and combinations thereof) that are present in the Nanobodies of the invention are as described herein. Other suitable CDR sequences can be obtained by the methods described herein.

According to a non-limiting but preferred aspect of the invention, (the CDR sequences present in) the Nanobodies of the invention are such that:

the Nanobodies can bind to IL-6R with a dissociation constant ($K_D$) of $10^{-5}$ to $10^{-12}$ moles/liter or less, and preferably $10^{-7}$ to $10^{-17}$ moles/liter or less and more preferably $10^{-8}$ to $10^{-12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles);

and/or such that:

the Nanobodies can bind to IL-6R with a $k_{on}$-rate of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $s^{-1}$, such as between $10^5$ $M^{-1}s^{-1}$ and $10^7$ $M^{-1}s^{-1}$;

and/or such that they:

the Nanobodies can bind to IL-6R with a $k_{off}$ rate between 1 $s^{-1}$ ($t_{1/2}$=0.69 s) and $10^{-6}$ $s^{-1}$ (providing a near irreversible complex with a $t_{1/2}$ of multiple days), preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Preferably, (the CDR sequences present in) the Nanobodies of the invention are such that: a monovalent Nanobody of the invention (or a polypeptide that contains only one Nanobody of the invention) is preferably such that it will bind to IL-6R with an affinity less than 500 nM, preferably less than 200 nM, more preferably less than 10 nM, such as less than 500 µM.

The affinity of the Nanobody of the invention against IL-6R can be determined in a manner known per se, for example using the general techniques for measuring $K_D$, $K_A$, $k_{off}$ or $k_{on}$ mentioned herein, as well as some of the specific assays described herein.

Some preferred IC50 values for binding of the Nanobodies of the invention (and of polypeptides comprising the same) to IL-6R will become clear from the further description and examples herein.

In a preferred but non-limiting aspect, the invention relates to a Nanobody (as defined herein) against IL-6R, which consists of 4 framework regions (FR1 to FR4 respectively) and 3 complementarity determining regions (CDR1 to CDR3 respectively), in which:

CDR1 is chosen from the group consisting of:
a) the amino acid sequences of SEQ ID NO's: 302-386;
b) amino acid sequences that have at least 80% amino acid identity with at least one of the amino acid sequences of SEQ ID NO's: 302-386;
c) amino acid sequences that have 3, 2, or 1 amino acid difference with at least one of the amino acid sequences of SEQ ID NO's: 302-386;

and/or

CDR2 is chosen from the group consisting of:
d) the amino acid sequences of SEQ ID NO's: 472-556;
e) amino acid sequences that have at least 80% amino acid identity with at least one of the amino acid sequences of SEQ ID NO's: 472-556;
f) amino acid sequences that have 3, 2, or 1 amino acid difference with at least one of the amino acid sequences of SEQ ID NO's: 472-556;

and/or

CDR3 is chosen from the group consisting of:
g) the amino acid sequences of SEQ ID NO's: 642-726;
h) amino acid sequences that have at least 80% amino acid identity with at least one of the amino acid sequences of SEQ ID NO's: 642-726;
i) amino acid sequences that have 3, 2, or 1 amino acid difference with at least one of the amino acid sequences of SEQ ID NO's: 642-726;
or any suitable fragment of such an amino acid sequence.

In particular, according to this preferred but non-limiting aspect, the invention relates to a Nanobody (as defined herein) against IL-6R, which consists of 4 framework regions (FR1 to FR4 respectively) and 3 complementarity determining regions (CDR1 to CDR3 respectively), in which:

CDR1 is chosen from the group consisting of:
a) the amino acid sequences of SEQ ID NO's: 302-386;
b) amino acid sequences that have at least 80% amino acid identity with at least one of the amino acid sequences of SEQ ID NO's: 302-386;
c) amino acid sequences that have 3, 2, or 1 amino acid difference with at least one of the amino acid sequences of SEQ ID NO's: 302-386;

and

CDR2 is chosen from the group consisting of:
d) the amino acid sequences of SEQ ID NO's: 472-556;
e) amino acid sequences that have at least 80% amino acid identity with at least one of the amino acid sequences of SEQ ID NO's: 472-556;
f) amino acid sequences that have 3, 2, or 1 amino acid difference with at least one of the amino acid sequences of SEQ ID NO's: 472-556;

and

CDR3 is chosen from the group consisting of:
g) the amino acid sequences of SEQ ID NO's: 642-726;
h) amino acid sequences that have at least 80% amino acid identity with at least one of the amino acid sequences of SEQ ID NO's: 642-726;
i) amino acid sequences that have 3, 2, or 1 amino add difference with at least one of the amino acid sequences of SEQ ID NO'S: 642-726;
or any suitable fragment of such an amino acid sequences.

As generally mentioned herein for the amino acid sequences of the invention, when a Nanobody of the invention contains one or more CDR1 sequences according to b) and/or c):

i) any amino acid substitution in such a CDR according to b) and/or c) is preferably, and compared to the corresponding CDR according to a), a conservative amino acid substitution (as defined herein);

and/or ii) the CDR according to b) and/or c) preferably only contains amino acid substitutions, and no amino acid deletions or insertions, compared to the corresponding CDR according to a);

and/or iii) the CDR according to b) and/or c) may be a CDR that is derived from a CDR according to a) by means of affinity maturation using one or more techniques of affinity maturation known per se.

Similarly, when a Nanobody of the invention contains one or more CDR2 sequences according to e) and/or f):

i) any amino acid substitution in such a CDR according to e) and/or f) is preferably, and compared to the corresponding CDR according to d), a conservative amino acid substitution (as defined herein);

and/or ii) the CDR according to e) and/or f) preferably only contains amino acid substitutions, and no amino acid deletions or insertions, compared to the corresponding CDR according to d);

and/or iii) the CDR according to e) and/or f) may be a CDR that is derived from a CDR according to d) by means of affinity maturation using one or more techniques of affinity maturation known per se.

Also, similarly, when a Nanobody of the invention contains one or more CDR3 sequences according to h) and/or i):

i) any amino acid substitution in such a CDR according to h) and/or i) is preferably, and compared to the corresponding CDR according to g), a conservative amino acid substitution (as defined herein);

and/or ii) the CDR according to h) and/or i) preferably only contains amino acid substitutions, and no amino acid deletions or insertions, compared to the corresponding CDR according to g);

and/or iii) the CDR according to h) and/or i) may be a CDR that is derived from a CDR according to g) by means of affinity maturation using one or more techniques of affinity maturation known per se.

It should be understood that the last three paragraphs generally apply to any Nanobody of the invention that comprises one or more CDR1 sequences, CDR2 sequences and/or CDR3 sequences according to b), c), e), f), h) or i), respectively.

Of the Nanobodies of the invention, Nanobodies comprising one or more of the CDR's explicitly listed above are particularly preferred; Nanobodies comprising two or more of the CDR's explicitly listed above are more particularly preferred; and Nanobodies comprising three of the CDR's explicitly listed above are most particularly preferred.

Some particularly preferred, but non-limiting combinations of CDR sequences, as well as preferred combinations of CDR sequences and framework sequences, are mentioned in Table A-1 below, which lists the CDR sequences and framework sequences that are present in a number of preferred (but non-limiting) Nanobodies of the invention. As will be clear to the skilled person, a combination of CDR1, CDR2 and CDR3 sequences that occur in the same clone (i.e. CDR1, CDR2 and CDR3 sequences that are mentioned on the same line in Table A-1) will usually be preferred (although the invention in its broadest sense is not limited thereto, and also comprises other suitable combinations of the CDR sequences mentioned in Table A-1). Also, a combination of CDR sequences and framework sequences that occur in the same clone (i.e. CDR sequences and framework sequences that are mentioned on the same line in Table A-1) will usually be preferred (although the invention in its broadest sense is not limited thereto, and also comprises other suitable combinations of the CDR sequences and framework sequences mentioned in Table A-1, as well as combinations of such CDR sequences and other suitable framework sequences, e.g. as further described herein).

Also, in the Nanobodies of the invention that comprise the combinations of CDR's mentioned in Table A-1, each CDR can be replaced by a CDR chosen from the group consisting of amino acid sequences that have at least 80%, preferably at least 90%, more preferably at least 95%, even more preferably at least 99% sequence identity (as defined herein) with the mentioned CDR's; in which:

i) any amino acid substitution in such a CDR is preferably, and compared to the corresponding CDR sequence mentioned in Table A-1, a conservative amino acid substitution (as defined herein);

and/or ii) any such CDR sequence preferably only contains amino acid substitutions, and no amino acid deletions or insertions, compared to the corresponding CDR sequence mentioned in Table A-1;

and/or iii) any such CDR sequence is a CDR that is derived by means of a technique for affinity maturation known per se, and in particular starting from the corresponding CDR sequence mentioned in Table A-1.

However, as will be clear to the skilled person, the (combinations of) CDR sequences, as well as (the combinations of) CDR sequences and framework sequences mentioned in Table A-1 will generally be preferred.

Thus, in the Nanobodies of the invention, at least one of the CDR1, CDR2 and CDR3 sequences present is suitably chosen from the group consisting of the CDR1, CDR2 and CDR3 sequences, respectively, listed in Table A-1; or from the group of CDR1, CDR2 and CDR3 sequences, respectively, that have at least 80%, preferably at least 90%, more preferably at least 95%, even more preferably at least 99% "sequence identity" (as defined herein) with at least one of the CDR1, CDR2 and CDR3 sequences, respectively, listed in Table A-1; and/or from the group consisting of the CDR1, CDR2 and CDR3 sequences, respectively, that have 3, 2 or only 1 "amino acid difference(s)" (as defined herein) with at least one of the CDR1, CDR2 and CDR3 sequences, respectively, listed in Table A-1.

In this context, by "suitably chosen" is meant that, as applicable, a CDR1 sequence is chosen from suitable CDR1 sequences (i.e. as defined herein), a CDR2 sequence is chosen from suitable CDR2 sequences (i.e. as defined herein), and a CDR3 sequence is chosen from suitable CDR3 sequence (i.e. as defined herein), respectively. More in particular, the CDR sequences are preferably chosen such that the Nanobodies of the invention bind to IL-6R with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein.

In particular, in the Nanobodies of the invention, at least the CDR3 sequence present is suitably chosen from the group consisting of the CDR3 sequences listed in Table A-1 or from the group of CDR3 sequences that have at least 80%, preferably at least 90%, more preferably at least 95%, even more preferably at least 99% sequence identity with at least one of the CDR3 sequences listed in Table A-1; and/or from the group consisting of the CDR3 sequences that have 3, 2 or only 1 amino acid difference(s) with at least one of the CDR3 sequences listed in Table A-1.

Preferably, in the Nanobodies of the invention, at least two of the CDR1, CDR2 and CDR3 sequences present are suitably chosen from the group consisting of the CDR1, CDR2 and CDR3 sequences, respectively, listed in Table A-1 or from the group consisting of CDR1, CDR2 and CDR3 sequences, respectively, that have at least 80%, preferably at least 90%, more preferably at least 95%, even more preferably at least 99% sequence identity with at least one of the CDR1, CDR2 and CDR3 sequences, respectively, listed in Table A-1; and/or from the group consisting of the CDR1, CDR2 and CDR3 sequences, respectively, that have 3, 2 or only 1 "amino acid difference(s)" with at least one of the CDR1, CDR2 and CDR3 sequences, respectively, listed in Table A-1.

In particular, in the Nanobodies of the invention, at least the CDR3 sequence present is suitably chosen from the group consisting of the CDR3 sequences listed in Table A-1 or from the group of CDR3 sequences that have at least 80%, preferably at least 90%, more preferably at least 95%, even more preferably at least 99% sequence identity with at least one of the CDR3 sequences listed in Table A-1, respectively; and at least one of the CDR1 and CDR2 sequences present is suitably chosen from the group consisting of the CDR1 and CDR2 sequences, respectively, listed in Table A-1 or from the group of CDR1 and CDR2 sequences, respectively, that have at least 80%, preferably at least 90%, more preferably at least 95%, even more preferably at least 99% sequence identity with at least one of the CDR1 and CDR2 sequences, respectively, listed in Table B-1; and/or from the group consisting of the CDR1 and CDR2 sequences, respectively, that have 3, 2 or only 1 amino acid difference(s) with at least one of the CDR1 and CDR2 sequences, respectively, listed in Table A-1.

Most preferably, in the Nanobodies of the invention, all three CDR1, CDR2 and CDR3 sequences present are suitably chosen from the group consisting of the CDR1, CDR2 and CDR3 sequences, respectively, listed in Table A-1 or from the group of CDR1, CDR2 and CDR3 sequences, respectively, that have at least 80%, preferably at least 90%, more preferably at least 95%, even more preferably at least 99% sequence identity with at least one of the CDR1, CDR2 and CDR3 sequences, respectively, listed in Table A-1; and/or from the group consisting of the CDR1, CDR2 and CDR3 sequences, respectively, that have 3, 2 or only 1 amino acid difference(s) with at least one of the CDR1, CDR2 and CDR3 sequences, respectively, listed in Table A-1.

Even more preferably, in the Nanobodies of the invention, at least one of the CDR1, CDR2 and CDR3 sequences present is suitably chosen from the group consisting of the CDR1, CDR2 and CDR3 sequences, respectively, listed in Table A-1. Preferably, in this aspect, at least one or preferably both of the other two CDR sequences present are suitably chosen from CDR sequences that have at least 80%, preferably at least 90%, more preferably at least 95%, even more preferably at least 99% sequence identity with at least one of the corresponding CDR sequences, respectively, listed in Table A-1; and/or from the group consisting of the CDR sequences that have 3, 2 or only 1 amino acid difference(s) with at least one of the corresponding sequences, respectively, listed in Table A-1.

In particular, in the Nanobodies of the invention, at least the CDR3 sequence present is suitably chosen from the group consisting of the CDR3 listed in Table A-1. Preferably, in this aspect, at least one and preferably both of the CDR1 and CDR2 sequences present are suitably chosen from the groups of CDR1 and CDR2 sequences, respectively, that have at least 80%, preferably at least 90%, more preferably at least 95%, even more preferably at least 99% sequence identity with the CDR1 and CDR2 sequences, respectively, listed in Table A-1; and/or from the group consisting of the CDR1 and CDR2 sequences, respectively, that have 3, 2 or only 1 amino acid difference(s) with at least one of the CDR1 and CDR2 sequences, respectively, listed in Table A-1.

Even more preferably, in the Nanobodies of the invention, at least two of the CDR1, CDR2 and CDR3 sequences present are suitably chosen from the group consisting of the CDR1, CDR2 and CDR3 sequences, respectively, listed in Table A-1. Preferably, in this aspect, the remaining CDR sequence present is suitably chosen from the group of CDR sequences that have at least 80%, preferably at least 90%, more preferably at least 95%, even more preferably at least 99% sequence identity with at least one of the corresponding CDR sequences listed in Table A-1; and/or from the group consisting of CDR sequences that have 3, 2 or only 1 amino acid difference(s) with at least one of the corresponding sequences listed in Table A-1.

In particular, in the Nanobodies of the invention, at least the CDR3 sequence is suitably chosen from the group consisting of the CDR3 sequences listed in Table A-1, and either the CDR1 sequence or the CDR2 sequence is suitably chosen from the group consisting of the CDR1 and CDR2 sequences, respectively, listed in Table A-1. Preferably, in this aspect, the remaining CDR sequence present is suitably chosen from the group of CDR sequences that have at least 80%, preferably at least 90%, more preferably at least 95%, even more preferably at least 99% sequence identity with at least one of the corresponding CDR sequences listed in Table A-1; and/or from the group consisting of CDR sequences that have 3, 2 or only 1 amino acid difference(s) with the corresponding CDR sequences listed in Table A-1.

Even more preferably, in the Nanobodies of the invention, all three CDR1, CDR2 and CDR3 sequences present are suitably chosen from the group consisting of the CDR1, CDR2 and CDR3 sequences, respectively, listed in Table A-1.

Also, generally, the combinations of CDR's listed in Table A-1 (i.e. those mentioned on the same line in Table A-1) are preferred. Thus, it is generally preferred that, when a CDR in a Nanobody of the invention is a CDR sequence mentioned in Table A-1 or is suitably chosen from the group of CDR sequences that have at least 80%, preferably at least 90%, more preferably at least 95%, even more preferably at least 99% sequence identity with a CDR sequence listed in Table A-1; and/or from the group consisting of CDR sequences that have 3, 2 or only 1 amino acid difference(s) with a CDR sequence listed in Table A-1, that at least one and preferably both of the other CDR's are suitably chosen from the CDR sequences that belong to the same combination in Table A-1 (i.e. mentioned on the same line in Table A-1) or are suitably chosen from the group of CDR sequences that have at least 80%, preferably at least 90%, more preferably at least 95%, even more preferably at least 99% sequence identity with the CDR sequence(s) belonging to the same combination and/or from the group consisting of CDR sequences that have 3, 2 or only 1 amino acid difference(s) with the CDR sequence(s) belonging to the same combination. The other preferences indicated in the above paragraphs also apply to the combinations of CDR's mentioned in Table A-1.

Thus, by means of non-limiting examples, a Nanobody of the invention can for example comprise a CDR1 sequence that has more than 80% sequence identity with one of the CDR1 sequences mentioned in Table A-1, a CDR2 sequence that has 3, 2 or 1 amino acid difference with one of the CDR2 sequences mentioned in Table A-1 (but belonging to a different combination), and a CDR3 sequence.

Some preferred Nanobodies of the invention may for example comprise: (1) a CDR1 sequence that has more than 80% sequence identity with one of the CDR1 sequences mentioned in Table A-1; a CDR2 sequence that has 3, 2 or 1 amino acid difference with one of the CDR2 sequences mentioned in Table A-1 (but belonging to a different combination); and a CDR3 sequence that has more than 80% sequence identity with one of the CDR3 sequences mentioned in Table A-1 (but belonging to a different combination); or (2) a CDR1 sequence that has more than 80% sequence identity with one of the CDR1 sequences mentioned in Table A-1; a CDR2 sequence, and one of the CDR3 sequences listed in Table A-1; or (3) a CDR1 sequence; a CDR2 sequence that has more than 80% sequence identity with one of the CDR2 sequence listed in Table A-1; and a CDR3 sequence that has 3, 2 or 1 amino acid differences with the CDR3 sequence mentioned in Table A-1 that belongs to the same combination as the CDR2 sequence.

Some particularly preferred Nanobodies of the invention may for example comprise: (1) a CDR1 sequence that has more than 80% sequence identity with one of the CDR1 sequences mentioned in Table A-1; a CDR2 sequence that has 3, 2 or 1 amino acid difference with the CDR2 sequence mentioned in Table A-1 that belongs to the same combination; and a CDR3 sequence that has more than 80% sequence identity with the CDR3 sequence mentioned in Table A-1 that belongs to the same combination; (2) a CDR1 sequence; a CDR 2 listed in Table A-1 and a CDR3 sequence listed in Table A-1 (in which the CDR2 sequence and CDR3 sequence may belong to different combinations).

Some even more preferred Nanobodies of the invention may for example comprise: (1) a CDR1 sequence that has more than 80% sequence identity with one of the CDR1 sequences mentioned in Table A-1; the CDR2 sequence listed in Table A-1 that belongs to the same combination; and a CDR3 sequence mentioned in Table A-1 that belongs to a different combination; or (2) a CDR1 sequence mentioned in Table A-1; a CDR2 sequence that has 3, 2 or 1 amino acid differences with the CDR2 sequence mentioned in Table A-1 that belongs to the same combination; and a CDR3 sequence that has more than 80% sequence identity with the CDR3 sequence listed in Table A-1 that belongs to the same or a different combination.

Particularly preferred Nanobodies of the invention may for example comprise a CDR1 sequence mentioned in Table A-1, a CDR2 sequence that has more than 80% sequence identity with the CDR2 sequence mentioned in Table A-1 that belongs to the same combination; and the CDR3 sequence mentioned in Table A-1 that belongs to the same combination.

In the most preferred Nanobodies of the invention, the CDR1, CDR2 and CDR3 sequences present are suitably chosen from one of the combinations of CDR1, CDR2 and CDR3 sequences, respectively, listed in Table A-1.

According to another preferred, but non-limiting aspect of the invention (a) CDR1 has a length of between 1 and 12 amino acid residues, and usually between 2 and 9 amino acid residues, such as 5, 6 or 7 amino acid residues; and/or (b) CDR2 has a length of between 13 and 24 amino acid residues, and usually between 15 and 21 amino acid residues, such as 16 and 17 amino acid residues; and/or (c) CDR3 has a length of between 2 and 35 amino acid residues, and usually between 3 and 30 amino acid residues, such as between 6 and 23 amino acid residues.

In another preferred, but non-limiting aspect, the invention relates to a Nanobody in which the CDR sequences (as defined herein) have more than 80%, preferably more than 90%, more preferably more than 95%, such as 99% or more sequence identity (as defined herein) with the CDR sequences of at least one of the amino acid sequences of SEQ ID NO's: 132-216 (see Tables A-1 and A-3).

Generally, Nanobodies with the above CDR sequences may be as further described herein, and preferably have framework sequences that are also as further described herein. Thus, for example and as mentioned herein, such Nanobodies may be naturally occurring Nanobodies (from any suitable species), naturally occurring $V_{HH}$ sequences (i.e. from a suitable species of Camelid) or synthetic or semi-synthetic amino acid sequences or Nanobodies, including but not limited to partially humanized Nanobodies or $V_{HH}$ sequences, fully humanized Nanobodies or $V_{HH}$ sequences, camelized heavy chain variable domain sequences, as well as Nanobodies that have been obtained by the techniques mentioned herein.

Thus, in one specific, but non-limiting aspect, the invention relates to a humanized Nanobody, which consists of 4 framework regions (FR1 to FR4 respectively) and 3 complementarity determining regions (CDR1 to CDR3 respectively), in which CDR1 to CDR3 are as defined herein and in which said humanized Nanobody comprises at least one humanizing substitution (as defined herein), and in particular at least one humanizing substitution in at least one of its framework sequences (as defined herein).

In another preferred, but non-limiting aspect, the invention relates to a Nanobody in which the CDR sequences have at least 70% amino acid identity, preferably at least 80% amino acid identity, more preferably at least 90% amino acid identity, such as 95% amino acid identity, 99% amino acid identity or more or even essentially 100% amino acid identity with the CDR sequences of at least one of the amino acid sequences of SEQ ID NO's: 132-216 (see Table A-1). This degree of amino acid identity can for example be determined by determining the degree of amino acid identity (in a manner described herein) between said Nanobody and one or more of the sequences of SEQ ID NO's: 132-216 (see Table A-1), in which the amino acid residues that form the framework regions are disregarded. Such Nanobodies can be as further described herein.

In another preferred, but non-limiting aspect, the invention relates to a Nanobody with an amino acid sequence that is chosen from the group consisting of SEQ ID NO's: 132-216 (see Table A-1) or from the group consisting of from amino acid sequences that have more than 80%, preferably more than 90%, more preferably more than 95%, such as 99% or more sequence identity (as defined herein) with at least one of the amino acid sequences of SEQ ID NO's: 132-216 (see Table A-1).

Another preferred, but non-limiting aspect of the invention relates to humanized variants of the Nanobodies of SEQ ID NO's: 132-216 (see Table A-1), that comprise, compared to the corresponding native $V_{HH}$ sequence, at least one humanizing substitution (as defined herein), and in particular at least one humanizing substitution in at least one of its framework sequences (as defined herein).

The amino acid sequences and/or Nanobodies provided by the invention are preferably in essentially isolated form (as defined herein), or form part of a protein or polypeptide of the invention (as defined herein), preferably a biparatopic (or multiparatopic) polypeptide of the invention, which may comprise or essentially consist of one or more amino acid sequences and/or Nanobodies of the invention and which may optionally further comprise one or more further amino acid sequences and/or Nanobodies (all optionally linked via one or more suitable linkers). For example, and without limitation, the one or more amino acid sequences and/or Nanobodies of the invention may be used as a binding unit in such a protein or polypeptide, which may optionally contain one or more further amino acid sequences and/or Nanobodies that can serve as a binding unit (i.e. against one or more other targets than IL-6R), so as to provide a monovalent, multivalent, multiparatopic or multispecific polypeptide of the invention, respectively, all as described herein. Such a protein or polypeptide may also be in essentially isolated form (as defined herein).

Accordingly, the invention also provides compounds and constructs, and in particular proteins and polypeptides (also referred to herein as "compound of the invention", "construct of the invention" and "polypeptide of the invention"), that comprise or essentially consists of at least one such biparatopic (or multiparatopic) polypeptide, amino acid sequence and/or Nanobody of the invention (or suitable fragments thereof), and optionally further comprises one or more other groups, residues, moieties or binding units. As will become clear to the skilled person from the further disclosure herein, such further groups, residues, moieties, binding units or amino acid sequences may or may not provide further functionality to the amino acid sequence and/or Nanobody of the invention (and/or to the compound or construct in which it is present) and may or may not modify the properties of the amino acid sequence and/or Nanobody of the invention.

For example, such further groups, residues, moieties or binding units may be one or more additional amino acid sequences, such that the compound or construct is a (fusion) protein or (fusion) polypeptide. In a preferred but non-limiting aspect, said one or more other groups, residues, moieties or binding units are immunoglobulin sequences. Even more preferably, said one or more other groups, residues, moieties or binding units are chosen from the group consisting of domain antibodies, amino acid sequences that are suitable for use as a domain antibody, single domain antibodies, amino acid sequences that are suitable for use as a single domain antibody, "dAb"'s, amino acid sequences that are suitable for use as a dAb, or Nanobodies.

Alternatively, such groups, residues, moieties or binding units may for example be chemical groups, residues, moieties, which may or may not by themselves be biologically and/or pharmacologically active. For example, and without limitation, such groups may be linked to the one or more amino acid sequences of the invention so as to provide a "derivative" of an amino acid sequence or polypeptide of the invention, as further described herein.

Also within the scope of the present invention are compounds or constructs, that comprises or essentially consists of one or more derivatives as described herein, and optionally further comprises one or more other groups, residues, moieties or binding units, optionally linked via one or more linkers. Preferably, said one or more other groups, residues, moieties or binding units are amino acid sequences.

In the compounds or constructs described above, the one or more biparatopic (or multiparatopic) polypeptides, amino acid sequences and/or Nanobodies of the invention and the one or more groups, residues, moieties or binding units may be linked directly to each other and/or via one or more suitable linkers or spacers. For example, when the one or more groups, residues, moieties or binding units are amino acid sequences, the linkers may also be amino acid sequences, so that the resulting compound or construct is a fusion (protein) or fusion (polypeptide).

Accordingly, the invention also relates to a polypeptide that comprises or essentially consist of a Nanobody of the invention. Without being limiting, the biparatopic (or multiparatopic) polypeptides of the invention described herein will preferably also comprise or essentially consist of at least one Nanobody of the invention. However, also encompassed within the present invention are biparatopic (or multiparatopic) polypeptides that comprise amino acid sequences and/or Nanobodies that are not described herein as (preferred) amino acid sequences and/or Nanobodies of the invention. As long as these amino acid sequences and/or Nanobodies are also capable of binding two or more different antigenic determinants or epitopes on IL-6R, the resulting biparatopic (or multiparatopic) polypeptides will also be considered a biparatopic (or multiparatopic) polypeptide of the invention. Some preferred, but non-limiting examples of polypeptides of the invention are given in SEQ ID NO's: 812-947 (see Tables A-4, A-5 and A-6).

It will be clear to the skilled person that the Nanobodies that are mentioned herein as "preferred" (or "more preferred", "even more preferred", etc.) are also preferred (or more preferred, or even more preferred, etc.) for use in the (multiparatopic) polypeptides described herein. Thus, polypeptides that comprise or essentially consist of one or more "preferred" Nanobodies of the invention will generally be preferred, and polypeptides that comprise or essentially consist of one or more "more preferred" Nanobodies of the invention will generally be more preferred, etc.

Generally, proteins or polypeptides that comprise or essentially consist of a single Nanobody (such as a single Nanobody of the invention) will be referred to herein as "monovalent" proteins or polypeptides or as "monovalent constructs". Proteins and polypeptides that comprise or essentially consist of two or more Nanobodies (such as at least two Nanobodies of the invention or at least one Nanobody of the invention and at least one other Nanobody) will be referred to herein as "multivalent" proteins or polypeptides or as "multivalent constructs", and these may provide certain advantages compared to the corresponding monovalent Nanobodies of the invention. Some non-limiting examples of such multivalent constructs will become clear from the further description herein.

According to one specific, but non-limiting aspect, a polypeptide of the invention comprises or essentially consists of at least two Nanobodies of the invention, such as two or three Nanobodies of the invention. As further described herein, such multivalent constructs can provide certain advantages compared to a protein or polypeptide comprising or essentially consisting of a single Nanobody of the invention, such as a much improved avidity for IL-6R. Such multivalent constructs will be clear to the skilled person based on the disclosure herein.

According to another specific, but non-limiting aspect, a polypeptide of the invention comprises or essentially consists of at least one Nanobody of the invention and at least one other binding unit (i.e. directed against another epitope, antigen, target, protein or polypeptide), which is preferably also a Nanobody. Such proteins or polypeptides are also referred to herein as "multispecific" proteins or polypeptides or as 'multispecific constructs", and these may provide certain advantages compared to the corresponding monovalent Nanobodies of the invention (as will become clear from the further discussion herein of some preferred, but-nonlimiting multispecific constructs). Such multispecific constructs will be clear to the skilled person based on the disclosure herein.

Polypeptides of the invention that contain at least two Nanobodies, in which at least one Nanobody is directed against a first antigen (i.e. against IL-6R) and at least one Nanobody is directed against a second antigen (i.e. different from IL-6R), will also be referred to as "multispecific" polypeptides of the invention, and the Nanobodies present in such polypeptides will also be referred to herein as being in a "multispecific format". Thus, for example, a "bispecific" polypeptide of the invention is a polypeptide that comprises at least one Nanobody directed against a first antigen (i.e. IL-6R) and at least one further Nanobody directed against a second antigen (i.e. different from IL-6R), whereas a "trispecific" polypeptide of the invention is a polypeptide that comprises at least one Nanobody directed against a first antigen (i.e. IL-6R), at least one further Nanobody directed against a second antigen (i.e. different from IL-6R) and at least one further Nanobody directed against a third antigen (i.e. different from both IL-6R, and the second antigen); etc.

Accordingly, in its simplest form, a bispecific polypeptide of the invention is a bivalent polypeptide of the invention (as defined herein), comprising a first Nanobody directed against IL-6R, and a second Nanobody directed against a second antigen, in which said first and second Nanobody may optionally be linked via a linker sequence (as defined herein); whereas a trispecific polypeptide of the invention in its simplest form is a trivalent polypeptide of the invention (as defined herein), comprising a first Nanobody directed against IL-6R, a second Nanobody directed against a second antigen and a third Nanobody directed against a third antigen, in which said first, second and third Nanobody may optionally be linked via one or more, and in particular one and more, in particular two, linker sequences.

However, as will be clear from the description hereinabove, the invention is not limited thereto, in the sense that a multispecific polypeptide of the invention may comprise at least one Nanobody against IL-6R], and any number of Nanobodies directed against one or more antigens different from IL-6R.

According to another specific, but non-limiting aspect, a polypeptide of the invention comprises or essentially consists of at least one Nanobody of the invention and at least one other binding unit directed against IL-6R (i.e. directed against another antigenic determinant or epitope), which is preferably also a Nanobody. Such proteins or polypeptides are also referred to herein as "multiparatopic" proteins or polypeptides or as 'multiparatopic constructs", and these may provide certain advantages compared to the corresponding monovalent Nanobodies of the invention (as will become clear from the further discussion herein of some preferred, but-nonlimiting multiparatopic constructs). Such multiparatopic constructs will be clear to the skilled person based on the disclosure herein; some preferred, but non-limiting examples of such multiparatopic Nanobody constructs are the constructs of SEQ ID NO's: 812-947.

Furthermore, although it is encompassed within the scope of the invention that the specific order or arrangement of the various Nanobodies in the polypeptides of the invention may have some influence on the properties of the final polypeptide of the invention (including but not limited to the affinity, specificity or avidity for IL-6R, or against the one or more other antigens), said order or arrangement is usually not critical and may be suitably chosen by the skilled person, optionally after some limited routine experiments based on the disclosure herein. Thus, when reference is made to a specific multivalent or multispecific polypeptide of the invention, it should be noted that this encompasses any order or arrangements of the relevant Nanobodies, unless explicitly indicated otherwise.

Finally, it is also within the scope of the invention that the polypeptides of the invention contain two or more Nanobodies and one or more further amino acid sequences (as mentioned herein).

For multivalent and multispecific polypeptides containing one or more $V_{HH}$ domains and their preparation, reference is also made to Conrath et al., J. Biol. Chem., Vol. 276, 10. 7346-7350, 2001; Muyldermans, Reviews in Molecular Biotechnology 74 (2001), 277-302; as well as to for example WO 96/34103 and WO 99/23221. Some other examples of some specific multispecific and/or multivalent polypeptide of the invention can be found in the applications by Ablynx N.V. referred to herein.

As will be clear from the further description above and herein, this means that the amino acid sequences and/or Nanobodies of the invention can be used as "building blocks" to form polypeptides (preferably biparatopic polypeptides) of the invention, i.e. by suitably combining them with other groups, residues, moieties or binding units, in order to form compounds or constructs as described herein (such as, without limitations, the bi/multiparatopic. bi/multivalent and bi/multispecific polypeptides of the invention described herein) which combine within one molecule one or more desired properties or biological functions.

The compounds or polypeptides of the invention can generally be prepared by a method which comprises at least one step of suitably linking the one or more amino acid sequences and/or Nanobodies of the invention to the one or more further groups, residues, moieties or binding units, optionally via the one or more suitable linkers, so as to provide the compound or polypeptide of the invention. Polypeptides of the invention can also be prepared by a method which generally comprises at least the steps of providing a nucleic acid that encodes a polypeptide of the invention, expressing said nucleic acid in a suitable manner, and recovering the expressed polypeptide of the invention. Such methods can be performed in a manner known per se, which will be clear to the skilled person, for example on the basis of the methods and techniques further described herein.

The process of designing/selecting and/or preparing a compound or polypeptide of the invention, starting from an amino acid sequence and/or Nanobody (of the invention), is also referred to herein as "formatting" said amino acid sequence and/or Nanobody (of the invention); and an amino acid and/or Nanobody (of the invention) that is made part of a compound or polypeptide of the invention is said to be "formatted" or to be in the format of said compound or polypeptide of the invention. Examples of ways in which an amino acid sequence and/or Nanobody (of the invention) can be formatted and examples of such formats will be clear to the skilled person based on the disclosure herein; and such formatted amino acid sequences and/or Nanobody (of the invention) form a further aspect of the invention. As described herein, preferred formats in the present invention are biparatopic (or multiparatopic) polypeptides.

Therefore, in a preferred aspect, the invention also provides a method for preparing a multivalent (such as multiparatopic, and preferably biparatopic) polypeptides of the invention comprising at least the steps of linking two or more monovalent amino acid sequences and/or Nanobodies, or monovalent constructs and for example one or more linkers together in a suitable manner. The monovalent amino acid sequences and/or Nanobodies or the monovalent constructs (and linkers) can be coupled by any method known in the art and as further described herein. Preferred techniques include the linking of the nucleic acid sequences that encode the monovalent amino acid sequences and/or Nanobodies or monovalent constructs (and linkers) to prepare a genetic construct that expresses the multivalent (such as multiparatopic, and preferably biparatopic) polypeptide of the invention. Techniques for linking amino acid sequences or nucleic acid sequences will be clear to the skilled person, and reference is again made to the standard handbooks, such as Sambrook et al. and Ausubel et al., mentioned herein, as well as the Examples below.

Accordingly, the present invention also relates to the use of a monovalent construct (which may comprise or essentially consists of an amino acid sequence such as a domain antibody, an amino acid sequence that is suitable for use as a domain antibody, a single domain antibody, an amino acid sequence that is suitable for use as a single domain antibody, a "dAb", an amino acid sequences that is suitable for use as a dAb, or a Nanobody) in providing and/or preparing a multivalent (such as multiparatopic, and preferably biparatopic) compound, construct or polypeptide. The monovalent construct is then used as a binding domain or binding unit in providing and/or preparing the multivalent (such as multiparatopic, and preferably biparatopic) construct comprising two (e.g. in a biparatopic construct) or more (e.g. in a multiparatopic construct) binding units. In this respect, the monovalent construct may be used as a binding domain or binding unit in providing and/or preparing a multivalent (such as multiparatopic, and preferably biparatopic) construct of the invention comprising two or more binding units.

The monovalent construct that is used as a binding domain or binding unit may comprise or essentially consists of any amino acid sequences and/or Nanobodies that is capable of binding to at least one antigenic determinant, epitope, part or domain on IL-6R. Preferred amino acid sequences and/or Nanobodies are e.g. described in WO 08/020,079 and/or are described herein (referred to herein as "amino acid sequence of the invention" and "Nanobody of the invention").

In a preferred aspect, the monovalent construct (which may comprise or essentially consists of an amino acid sequence such as a domain antibody, an amino acid sequence that is suitable for use as a domain antibody, a single domain antibody, an amino acid sequence that is suitable for use as a single domain antibody, a "dAb", an amino acid sequences that is suitable for use as a dAb, or a Nanobody) is used in providing and/or preparing a multivalent (such as multiparatopic, and preferably biparatopic) construct that exhibits intramolecular binding compared to intermolecular binding. In such multivalent constructs of the invention that comprises amino acid sequences directed against two or more (different) antigenic determinants on IL-6R (for example against different epitopes of IL-6R), the length and flexibility of the linker are preferably such that, when the multivalent (such as multiparatopic, and preferably biparatopic) construct binds to IL-6R, at least two and preferably all of the amino acid sequences that are present in the multivalent construct can (simultaneously) bind to each of their intended antigenic determinants, epitopes, parts or domains, most preferably so as to allow binding with increased avidity and also intramolecular binding and/or recognition. Accordingly, the present invention also relates to the use of a monovalent construct (which may comprise or essentially consists of an amino acid sequence such as a domain antibody, an amino acid sequence that is suitable for use as a domain antibody, a single domain antibody, an amino acid sequence that is suitable for use as a single domain antibody, a "dAb", an amino acid sequences that is suitable for use as a dAb, or a Nanobody) as a binding domain or binding unit in providing and/or preparing a multivalent (such as multiparatopic, and preferably biparatopic) construct, wherein the binding domains or binding units are linked via a linker such that the multivalent (such as multiparatopic, and preferably biparatopic) construct preferably exhibits intramolecular binding compared to intermolecular binding.

In some of the preferred multiparatopic, and preferably biparatopic polypeptides of the invention, (i) at least one monovalent construct (and in particular at least one Nanobody) is used that is directed against the IL-6 binding site on IL-6R (and in particular against one or more of the 18 contact residues as described in Boulanger et al. 2003 (Science 300, 2101-2104) present in the extracellular D3 domain of the IL-6R, more preferably against amino acid residues Phe229 and Phe279 present in the extracellular D3 domain of the IL-6R) and/or that is capable of competing with IL-6 for binding to IL-6R; and at least one amino acid sequence (and in particular at least one Nanobody) is used that is directed against another antigenic determinant, epitope, part or domain of IL-6R. In such a preferred multiparatopic construct of the invention, the linker is most preferably such that the multiparatopic construct of the invention is capable of (simultaneously) binding to both the IL-6 binding site on IL-6R (and in particular to one or more of the 18 contact residues as described in Boulanger et al. 2003 (Science 300, 2101-2104) present in the extracellular D3 domain of the IL-6R, more preferably to amino acid residues Phe229 and Phe279 present in the extracellular D3 domain of the IL-6R) as well as to the other antigenic determinant, epitope, part or domain of IL-6R, again most preferably so as to allow binding with increased avidity and also intramolecular binding and/or recognition. Accordingly, also encompassed in the present invention is the use of a monovalent construct comprising an amino acid sequence (and in particular a Nanobody) that is directed against the IL-6 binding site on IL-6R (and in particular against one or more of the 18 contact residues as described in Boulanger et al. 2003 (Science 300, 2101-2104) present in the extracellular D3 domain of the IL-6R, more preferably against amino acid residues Phe229 and Phe279 present in the extracellular D3 domain of the IL-6R) and/or that is capable of competing with IL-6 for binding to IL-6R, as a binding domain or binding unit in providing and/or preparing a multiparatopic (such as biparatopic) construct, wherein the binding domains or binding units are linked via a linker such that the multiparatopic (such as biparatopic) construct preferably exhibits intramolecular binding compared to intermolecular binding.

In some of the preferred multiparatopic, and preferably biparatopic polypeptides of the invention, (i) at least one monovalent construct (and in particular at least one Nanobody) is used that is directed against the gp130 binding site on IL-6R and/or the IL-6/IL-6R complex and/or that is capable of competing with gp130 for binding to the IL-6/IL-6R complex; and at least one amino acid sequence (and in particular at least one Nanobody) is used that is directed against another antigenic determinant, epitope, part or domain of IL-6R. In such a preferred multiparatopic construct of the invention, the linker is most preferably such that the multiparatopic construct of the invention is capable of (simultaneously) binding to both the gp130 binding site on IL-6R and/or the IL-6/IL-6R complex as well as to the other antigenic determinant, epitope, part or domain of IL-6R, again most preferably so as to allow binding with increased avidity and also intramolecular binding and/or recognition. Accordingly, also encompassed in the present invention is the use of a monovalent construct comprising an amino acid (and in particular a Nanobody) that is directed against the gp130 binding site on IL-6R and/or the IL-6/IL-6R complex and/or that is capable of competing with gp130 for binding to the IL-6/IL-6R complex, as a binding domain or binding unit in providing and/or preparing a multiparatopic (such as biparatopic) construct, wherein the binding domains or binding units are linked via a linker such that the multiparatopic (such as biparatopic) construct preferably exhibits intramolecular binding compared to intermolecular binding.

In some of the most preferred multiparatopic, and preferably biparatopic polypeptides of the invention, (i) at least one monovalent construct (and in particular at least one Nanobody) is used that is directed against the Tocilizumab (MRA) binding site on IL-6R and/or that is capable of competing with Tocilizumab (MRA) for binding to IL-6R; and at least one amino acid sequence (and in particular at least one Nanobody) is used that is directed against another antigenic determinant, epitope, part or domain of IL-6R. In such a preferred multiparatopic construct of the invention, the linker is most preferably such that the multiparatopic construct of the invention is capable of (simultaneously) binding to both the Tocilizumab (MRA) binding site on IL-6R as well as to the other antigenic determinant, epitope, part or domain of IL-6R, again most preferably so as to allow binding with increased avidity and also intramolecular binding and/or recognition. Accordingly, also encompassed in the present invention is the use of a monovalent construct comprising an amino acid of the invention (and in particular a Nanobody) that is directed against the Tocilizumab (MRA) binding site on IL-6R and/or that is capable of competing with Tocilizumab (MRA) for binding to IL 6R, as a binding domain or binding unit in providing and/or preparing a multiparatopic (such as biparatopic) construct, wherein the binding domains or binding units are linked via a linker such that the multiparatopic (such as biparatopic) construct preferably exhibits intramolecular binding compared to intermolecular binding.

In some of the most preferred multiparatopic, and preferably biparatopic polypeptides of the invention, (i) at least one monovalent construct (and in particular at least one Nanobody) is used that is directed against the M182 binding site on IL-6R and/or that is capable of competing with M182 for binding to IL-6R; and at least one amino acid sequence (and in particular at least one Nanobody) is used that is directed against another antigenic determinant, epitope, part or domain of IL-6R. In such a preferred multiparatopic construct of the invention, the linker is most preferably such that the multiparatopic construct of the invention is capable of (simultaneously) binding to both the M182 binding site on IL-6R as well the other antigenic determinant, epitope, part or domain of IL-6R, again most preferably so as to allow binding with increased avidity and also intramolecular binding and/or recognition. Accordingly, also encompassed in the present invention is the use of a monovalent construct comprising an amino acid of the invention (and in particular a Nanobody) that is directed against the M182 binding site on IL-6R and/or that is capable of competing with M182 for binding to IL-6R, as a binding domain or binding unit in providing and/or preparing a multiparatopic (such as biparatopic) construct, wherein the binding domains or binding units are linked via a linker such that the multiparatopic (such as biparatopic) construct preferably exhibits intramolecular binding compared to intermolecular binding.

In some of the most preferred multiparatopic, and preferably biparatopic polypeptides of the invention, (i) at least one monovalent construct (and in particular at least one Nanobody) is used that is directed against the BN-12 binding site on IL-6R and/or that is capable of competing with BN-12 for binding to IL-6R; and at least one amino acid sequence (and in particular at least one Nanobody) is used that is directed against another antigenic determinant, epitope, part or domain of IL-6R. In such a preferred multiparatopic construct of the invention, the linker is most preferably such that the multiparatopic construct of the invention is capable of (simultaneously) binding to both the BN-12 binding site on IL-6R as well as the other antigenic determinant, epitope, part or domain of IL-6R, again most preferably so as to allow binding with increased avidity and also intramolecular binding and/or recognition. Accordingly, also encompassed in the present invention is the use of a monovalent construct comprising an amino acid of the invention (and in particular a Nanobody) that is directed against the BN-12 binding site on IL-6R and/or that is capable of competing with BN-12 for binding to IL-6R, as a binding domain or binding unit in providing and/or preparing a multiparatopic (such as biparatopic) construct, wherein the binding domains or binding units are linked via a linker such that the multiparatopic (such as biparatopic) construct preferably exhibits intramolecular binding compared to intermolecular binding.

As discussed above, the at least one further amino acid sequence and/or Nanobody that is used as a binding domain or binding unit in providing and/or preparing a multiparatopic (such as biparatopic) construct of the invention may be any amino acid sequence and/or Nanobody that is directed against and/or capable of binding IL-6R.

In a preferred but non-limiting aspect, the at least one further amino acid sequence and/or Nanobody that is capable of binding to at least one other antigenic determinant or epitope, part or domain on IL-6R binds an eptiope present in the extracellular D1 domain; and/or said at least one further amino acid sequence and/or Nanobody will recognize and/or specifically bind IL-6R while not binding the hybrid IL-6R (as described in Example 3; SEQ ID NO: 131). Accordingly, in a preferred but non-limiting aspect, the amino acid sequence and/or Nanobody that is used as a binding domain or binding unit in providing and/or preparing a multiparatopic (such as biparatopic) construct of the invention may be directed against an epitope that lies in, forms part of, or overlaps with (i.e. in the primary or tertiary structure) or is in close proximity to (i.e. in the primary or tertiary structure) the D1 domain of IL-6R and/or may be capable of specifically binding IL-6R while not binding the hybrid IL-6R (as described in Example 3; SEQ ID NO: 131).

In another preferred but non-limiting aspect, the at least one further amino acid sequence and/or Nanobody that is capable of binding to at least one other antigenic determinant or epitope, part or domain on IL-6R binds an eptiope present in the extracellular D2 domain; and/or said at least one further amino acid sequence and/or Nanobody will recognize and/or specifically bind IL-6R while not binding the hybrid IL-6R (as described in Example 3; SEQ ID NO: 131). Accordingly, in a preferred but non-limiting aspect, the amino acid sequence and/or Nanobody that is used as a binding domain or binding unit in providing and/or preparing a multiparatopic (such as biparatopic) construct of the invention may be directed against an epitope that lies in, forms part of, or overlaps with (i.e. in the primary or tertiary structure) or is in close proximity to (i.e. in the primary or tertiary structure) the D2 domain of IL-6R and/or may be capable of specifically binding IL-6R as well as binding the hybrid IL-6R (as described in Example 3; SEQ ID NO: 131).

In another preferred but non-limiting aspect, the at least one further amino acid sequence and/or Nanobody that is capable of binding to at least one other antigenic determinant or epitope, part or domain on IL-6R binds an eptiope present in the extracellular D3 domain; and/or said at least one further amino acid sequence and/or Nanobody will recognize and/or specifically bind IL-6R while not binding the hybrid IL-6R (as described in Example 3; SEQ ID NO: 131). Accordingly, in a preferred but non-limiting aspect, the amino acid sequence and/or Nanobody that is used as a binding domain or binding unit in providing and/or preparing a multiparatopic (such as biparatopic) construct of the invention may be directed against an epitope that lies in, forms part of, or overlaps with (i.e. in the primary or tertiary structure) or is in close proximity to (i.e. in the primary or tertiary structure) the D3 domain of IL-6R and/or may be capable of specifically binding IL-6R as well as binding the hybrid IL-6R (as described in Example 3; SEQ ID NO: 131).

In some of the preferred multiparatopic, and preferably biparatopic polypeptides of the invention, (i) at least one monovalent construct (and in particular at least one Nanobody) is used that is directed against the IL-6 binding site on IL-6R (and in particular against one or more of the 18 contact residues as described in Boulanger et al. 2003 (Science 300, 2101-2104) present in the extracellular D3 domain of the IL-6R, more preferably against amino acid residues Phe229 and Phe279 present in the extracellular D3 domain of the IL-6R) and/or that is capable of competing with IL-6 for binding to IL-6R; and at least one amino acid sequence (and in particular at least one Nanobody) is used that is directed against an antigenic determinant or epitope on IL-6R that lies in, forms part of, or overlaps with (i.e. in the primary or tertiary structure) or is in close proximity to (i.e. in the primary or tertiary structure) the D1 domain of IL-6R; and/or that is capable of specifically binding IL-6R while not binding the hybrid IL-6R (as described in Example 3; SEQ ID NO: 131). In such a preferred multiparatopic construct of the invention, the linker is most preferably such that the multiparatopic construct of the invention is capable of (simultaneously) binding to both the IL-6 binding site on IL-6R (and in particular to one or more of the 18 contact residues as described in Boulanger et al. 2003 (Science 300, 2101-2104) present in the extracellular D3 domain of the IL-6R, more preferably to amino acid residues Phe229 and Phe279 present in the extracellular D3 domain of the IL-6R) as well as to the other antigenic determinant or epitope on IL-6R that lies in, forms part of, or overlaps with (i.e. in the primary or tertiary structure) or is in close proximity to (i.e. in the primary or tertiary structure) the D1 domain of IL-6R, again most preferably so as to allow binding with increased avidity and also intramolecular binding and/or recognition. Accordingly, also encompassed in the present invention is the use of a monovalent construct comprising an amino acid sequence (and in particular a Nanobody) that is directed against the IL-6 binding site on IL-6R (and in particular against one or more of the 18 contact residues as described in Boulanger et al. 2003 (Science 300, 2101-2104) present in the extracellular D3 domain of the IL-6R, more preferably against amino acid residues Phe229 and Phe279 present in the extracellular D3 domain of the IL-6R) and/or that is capable of competing with IL-6 for binding to IL-6R; and a monovalent construct comprising an amino acid sequence (and in particular a Nanobody) that is directed against another antigenic determinant or epitope on IL-6R that lies in, forms part of, or overlaps with (i.e. in the primary or tertiary structure) or is in close proximity to (i.e. in the primary or tertiary structure) the D1 domain of IL-6R; and/or that may be capable of specifically binding IL-6R while not binding the hybrid IL-6R (as described in Example 3; SEQ ID NO: 131), as a binding domain or binding unit in providing and/or preparing a multiparatopic (such as biparatopic) construct, wherein the binding domains or binding units are linked via a linker such that the multiparatopic (such as biparatopic) construct preferably exhibits intramolecular binding compared to intermolecular binding.

In some of the preferred multiparatopic, and preferably biparatopic polypeptides of the invention, (i) at least one monovalent construct (and in particular at least one Nanobody) is used that is directed against the IL-6 binding site on IL-6R (and in particular against one or more of the 18 contact residues as described in Boulanger et al. 2003 (Science 300, 2101-2104) present in the extracellular D3 domain of the IL-6R, more preferably against amino acid residues Phe229 and Phe279 present in the extracellular D3 domain of the IL-6R) and/or that is capable of competing with IL-6 for binding to IL-6R; and at least one amino acid sequence (and in particular at least one Nanobody) is used that is directed against an antigenic determinant or epitope on IL-6R that lies in, forms part of, or overlaps with (i.e. in the primary or tertiary structure) or is in close proximity to (i.e. in the primary or tertiary structure) the D2 domain of IL-6R; and/or that is capable of specifically binding IL-6R as well as the hybrid IL-6R (as described in Example 3; SEQ ID NO: 131). In such a preferred multiparatopic construct of the invention, the linker is most preferably such that the multiparatopic construct of the invention is capable of (simultaneously) binding to both the IL-6 binding site on IL-6R (and in particular to one or more of the 18 contact residues as described in Boulanger et al. 2003 (Science 300, 2101-2104) present in the extracellular D3 domain of the IL-6R, more preferably to amino acid residues Phe229 and Phe279 present in the extracellular D3 domain of the IL-6R) as well as to the other antigenic determinant or epitope on IL-6R that lies in, forms part of, or overlaps with (i.e. in the primary or tertiary structure) or is in close proximity to (i.e. in the primary or tertiary structure) the D2 domain of IL-6R, again most preferably so as to allow binding with increased avidity and also intramolecular binding and/or recognition. Accordingly, also encompassed in the present invention is the use of a monovalent construct comprising an amino acid sequence (and in particular a Nanobody) that is directed against the IL-6 binding site on IL-6R (and in particular against one or more of the 18 contact residues as described in Boulanger et al. 2003 (Science 300, 2101-2104) present in the extracellular D3 domain of the IL-6R, more preferably against amino acid residues Phe229 and Phe279 present in the extracellular D3 domain of the IL-6R) and/or that is capable of competing with IL-6 for binding to IL-6R; and a monovalent construct comprising an amino acid sequence (and in particular a Nanobody) that is directed against another antigenic determinant or epitope on IL-6R that lies in, forms part of, or overlaps with (i.e. in the primary or tertiary structure) or is in close proximity to (i.e. in the primary or tertiary structure) the D2 domain of IL-6R; and/or that may be capable of specifically binding IL-6R as well as the hybrid IL-6R (as described in Example 3; SEQ ID NO: 131), as a binding domain or binding unit in providing and/or preparing a multiparatopic (such as biparatopic) construct, wherein the binding domains or binding units are linked via a linker such that the multiparatopic (such as biparatopic) construct preferably exhibits intramolecular binding compared to intermolecular binding.

In some of the preferred multiparatopic, and preferably biparatopic polypeptides of the invention, (i) at least one monovalent construct (and in particular at least one Nanobody) is used that is directed against the IL-6 binding site on IL-6R (and in particular against one or more of the 18 contact residues as described in Boulanger et al. 2003 (Science 300, 2101-2104) present in the extracellular D3 domain of the IL-6R, more preferably against amino acid residues Phe229 and Phe279 present in the extracellular D3 domain of the IL-6R) and/or that is capable of competing with IL-6 for binding to IL-6R; and at least one amino acid sequence (and in particular at least one Nanobody) is used that is directed against an antigenic determinant or epitope on IL-6R that lies in, forms part of, or overlaps with (i.e. in the primary or tertiary structure) or is in close proximity to (i.e. in the primary or tertiary structure) the D3 domain of IL-6R; and/or that is capable of specifically binding IL-6R as well as the hybrid IL-6R (as described in Example 3; SEQ ID NO: 131). In such a preferred multiparatopic construct of the invention, the linker is most preferably such that the multiparatopic construct of the invention is capable of (simultaneously) binding to both the IL-6 binding site on IL-6R (and in particular to one or more of the 18 contact residues as described in Boulanger et al. 2003 (Science 300, 2101-2104) present in the extracellular D3 domain of the IL-6R, more preferably to amino acid residues Phe229 and Phe279 present in the extracellular D3 domain of the IL-6R) as well as to the other antigenic determinant or epitope on IL-6R that lies in, forms part of, or overlaps with (i.e. in the primary or tertiary structure) or is in close proximity to (i.e. in the primary or tertiary structure) the D3 domain of IL-6R, again most preferably so as to allow binding with increased avidity and also intramolecular binding and/or recognition. Accordingly, also encompassed in the present invention is the use of a monovalent construct comprising an amino acid sequence (and in particular a Nanobody) that is directed against the IL-6 binding site on IL-6R (and in particular against one or more of the 18 contact residues as described in Boulanger et al. 2003 (Science 300, 2101-2104) present in the extracellular D3 domain of the IL-6R, more preferably against amino acid residues Phe229 and Phe279 present in the extracellular D3 domain of the IL-6R) and/or that is capable of competing with IL-6 for binding to IL-6R; and a monovalent construct comprising an amino acid sequence (and in particular a Nanobody) that is directed against another antigenic determinant or epitope on IL-6R that lies in, forms part of, or overlaps with (i.e. in the primary or tertiary structure) or is in close proximity to (i.e. in the primary or tertiary structure) the D3 domain of IL-6R; and/or that may be capable of specifically binding IL-6R as well as the hybrid IL-6R (as described in Example 3; SEQ ID NO: 131), as a binding domain or binding unit in providing and/or preparing a multiparatopic (such as biparatopic) construct, wherein the binding domains or binding units are linked via a linker such that the multiparatopic (such as biparatopic) construct preferably exhibits intramolecular binding compared to intermolecular binding.

In some of the preferred multiparatopic, and preferably biparatopic polypeptides of the invention, (i) at least one monovalent construct (and in particular at least one Nanobody) is used that is directed against the gp130 binding site on IL-6R and/or the IL-6/IL-6R complex and/or that is capable of competing with gp130 for binding to the IL-6/IL-6R complex; and at least one amino acid sequence (and in particular at least one Nanobody) is used that is directed against an antigenic determinant or epitope on IL-6R that lies in, forms part of, or overlaps with (i.e. in the primary or tertiary structure) or is in close proximity to (i.e. in the primary or tertiary structure) the D1 domain of IL-6R; and/or that is capable of specifically binding IL-6R while not binding the hybrid IL-6R (as described in Example 3; SEQ ID NO: 131). In such a preferred multiparatopic construct of the invention, the linker is most preferably such that the multiparatopic construct of the invention is capable of (simultaneously) binding to both the gp130 binding site on IL-6R and/or the IL-6/IL-6R complex as well as to the antigenic determinant or epitope on IL-6R that lies in, forms part of, or overlaps with (i.e. in the primary or tertiary structure) or is in close proximity to (i.e. in the primary or tertiary structure) the D1 domain of IL-6R, again most preferably so as to allow binding with increased avidity and also intramolecular binding and/or recognition. Accordingly, also encompassed in the present invention is the use of a monovalent construct comprising an amino acid (and in particular a Nanobody) that is directed against the gp130 binding site on IL-6R and/or the IL-6/IL-6R complex and/or that is capable of competing with gp130 for binding to the IL-6/IL-6R complex, as a binding domain or binding unit in providing and/or preparing a multiparatopic (such as biparatopic) construct; and a monovalent construct comprising an amino acid (and in particular a Nanobody) that is directed against an antigenic determinant or epitope on IL-6R that lies in, forms part of, or overlaps with (i.e. in the primary or tertiary structure) or is in close proximity to (i.e. in the primary or tertiary structure) the D1 domain of IL-6R; and/or that is capable of specifically binding IL-6R while not binding the hybrid IL-6R (as described in Example 3; HQ ID NO: 131), wherein the binding domains or binding units are linked via a linker such that the multiparatopic (such as biparatopic) construct preferably exhibits intramolecular binding compared to intermolecular binding.

In some of the preferred multiparatopic, and preferably biparatopic polypeptides of the invention, (i) at least one monovalent construct (and in particular at least one Nanobody) is used that is directed against the gp130 binding site on IL-6R and/or the IL-6/IL-6R complex and/or that is capable of competing with gp130 for binding to the IL-6/IL-6R complex; and at least one amino acid sequence (and in particular at least one Nanobody) is used that is directed against an antigenic determinant or epitope on IL-6R that lies in, forms part of, or overlaps with (i.e. in the primary or tertiary structure) or is in close proximity to (i.e. in the primary or tertiary structure) the D2 domain of IL-6R; and/or that is capable of specifically binding IL-6R as well as the hybrid IL-6R (as described in Example 3; SEQ ID NO: 131). In such a preferred multiparatopic construct of the invention, the linker is most preferably such that the multiparatopic construct of the invention is capable of (simultaneously) binding to both the gp130 binding site on IL-6R and/or theft-6/IL-6R complex as well as to the antigenic determinant or epitope on IL-6R that lies in, forms part of, or overlaps with (i.e. in the primary or tertiary structure) or is in close proximity to (i.e. in the primary or tertiary structure) the D2 domain of IL-6R, again most preferably so as to allow binding with increased avidity and also intramolecular binding and/or recognition. Accordingly, also encompassed in the present invention is the use of a monovalent construct comprising an amino acid (and in particular a Nanobody) that is directed against the gp130 binding site on IL-6R and/or the IL-6/IL-6R complex and/or that is capable of competing with gp130 for binding to the IL-6/IL-6R complex, as a binding domain or binding unit in providing and/or preparing a multiparatopic (such as biparatopic) construct; and a monovalent construct comprising an amino acid (and in particular a Nanobody) that is directed against an antigenic determinant or epitope on IL-6R that lies in, forms part of, or overlaps with (i.e. in the primary or tertiary structure) or is in close proximity to (i.e. in the primary or tertiary structure) the D2 domain of IL-6R; and/or that is capable of specifically binding IL-6R as well as the hybrid IL-6R (as described in Example 3; SEQ ID NO: 131), wherein the binding domains or binding units are linked via a linker such that the multiparatopic (such as biparatopic) construct preferably exhibits intramolecular binding compared to intermolecular binding.

In some of the preferred multiparatopic, and preferably biparatopic polypeptides of the invention, (i) at least one monovalent construct (and in particular at least one Nanobody) is used that is directed against the gp130 binding site on IL-6R and/or the IL-6/IL-6R complex and/or that is capable of competing with gp130 for binding to the IL-6/IL-6R complex; and at least one amino acid sequence (and in particular at least one Nanobody) is used that is directed against an antigenic determinant or epitope on IL-6R that lies in, forms part of, or overlaps with (i.e. in the primary or tertiary structure) or is in close proximity to (i.e. in the primary or tertiary structure) the D3 domain of IL-6R; and/or that is capable of specifically binding IL-6R as well as the hybrid IL-6R (as described in Example 3; SEQ ID NO: 131). In such a preferred multiparatopic construct of the invention, the linker is most preferably such that the multiparatopic construct of the invention is capable of (simultaneously) binding to both the gp130 binding site on IL-6R and/or the IL-6/IL-6R complex as well as to the antigenic determinant or epitope on IL-6R that lies in, forms part of, or overlaps with (i.e. in the primary or tertiary structure) or is in close proximity to (i.e. in the primary or tertiary structure) the D3 domain of IL-6R, again most preferably so as to allow binding with increased avidity and also intramolecular binding and/or recognition. Accordingly, also encompassed in the present invention is the use of a monovalent construct comprising an amino acid (and in particular a Nanobody) that is directed against the gp130 binding site on IL-6R and/or the IL-6/IL-6R complex and/or that is capable of competing with gp130 for binding to the IL-6/IL-6R complex, as a binding domain or binding unit in providing and/or preparing a multiparatopic (such as biparatopic) construct; and a monovalent construct comprising an amino acid (and in particular a Nanobody) that is directed against an antigenic determinant or epitope on IL-6R that lies in, forms part of, or overlaps with (i.e. in the primary or tertiary structure) or is in close proximity to (i.e. in the primary or tertiary structure) the D3 domain of IL-6R; and/or that is capable of specifically binding IL-6R as well as the hybrid IL-6R (as described in Example 3; SEQ ID NO: 131), wherein the binding domains or binding units are linked via a linker such that the multiparatopic (such as biparatopic) construct preferably exhibits intramolecular binding compared to intermolecular binding.

In some of the most preferred multiparatopic, and preferably biparatopic polypeptides of the invention, (i) at least one monovalent construct (and in particular at least one Nanobody) is used that is directed against the Tocilizumab (MRA) binding site on IL-6R and/or that is capable of competing with Tocilizumab (MRA) for binding to IL-6R; and at least one amino acid sequence (and in particular at least one Nanobody) is used that is directed against an antigenic determinant or epitope on IL-6R that lies in, forms part of, or overlaps with (i.e. in the primary or tertiary structure) or is in close proximity to (i.e. in the primary or tertiary structure) the D1 domain of IL-6R; and/or that is capable of specifically binding IL-6R while not binding the hybrid IL-6R (as described in Example 3; SEQ ID NO: 131). In such a preferred multiparatopic construct of the invention, the linker is most preferably such that the multiparatopic construct of the invention is capable of (simultaneously) binding to both the Tocilizumab (MRA) binding site on IL-6R as well as to the antigenic determinant or epitope on IL-6R that lies in, forms part of, or overlaps with (i.e. in the primary or tertiary structure) or is in close proximity to (i.e. in the primary or tertiary structure) the D1 domain of IL-6R, again most preferably so as to allow binding with increased avidity and also intramolecular binding and/or recognition. Accordingly, also encompassed in the present invention is the use of a monovalent construct comprising an amino acid of the invention (and in particular a Nanobody) that is directed against the Tocilizumab (MRA) binding site on IL-6R and/or that is capable of competing with Tocilizumab (MRA) for binding to IL-6R; and a monovalent construct comprising an amino acid of the invention (and in particular a Nanobody) that is directed against an antigenic determinant or epitope on IL-6R that lies in, forms part of, or overlaps with (i.e. in the primary or tertiary structure) or is in close proximity to (i.e. in the primary or tertiary structure) the D1 domain of IL-6R; and/or that is capable of specifically binding IL-6R while not binding the hybrid IL-6R (as described in Example 3; SEQ ID NO: 131), as a binding domain or binding unit in providing and/or preparing a multiparatopic (such as biparatopic) construct, wherein the binding domains or binding units are linked via a linker such that the multiparatopic (such as biparatopic) construct preferably exhibits intramolecular binding compared to intermolecular binding.

In some of the most preferred multiparatopic, and preferably biparatopic polypeptides of the invention, (i) at least one monovalent construct (and in particular at least one Nanobody) is used that is directed against the Tocilizumab (MRA) binding site on IL-6R and/or that is capable of competing with Tocilizumab (MRA) for binding to IL-6R; and at least one amino acid sequence (and in particular at least one Nanobody) is used that is directed against an antigenic determinant or epitope on IL-6R that lies in, forms part of, or overlaps with (i.e. in the primary or tertiary structure) or is in close proximity to (i.e. in the primary or tertiary structure) the D2 domain of IL-6R; and/or that is capable of specifically binding IL-6R as well as the hybrid IL-6R (as described in Example 3; SEQ ID NO: 131). In such a preferred multiparatopic construct of the invention, the linker is most preferably such that the multiparatopic construct of the invention is capable of (simultaneously) binding to both the Tocilizumab (MRA) binding site on IL-6R as well as to the antigenic determinant or epitope on IL-6R that lies in, forms part of, or overlaps with (i.e. in the primary or tertiary structure) or is in close proximity to (i.e. in the primary or tertiary structure) the D2 domain of IL-6R, again most preferably so as to allow binding with increased avidity and also intramolecular binding and/or recognition. Accordingly, also encompassed in the present invention is the use of a monovalent construct comprising an amino acid of the invention (and in particular a Nanobody) that is directed against the Tocilizumab (MRA) binding site on IL-6R and/or that is capable of competing with Tocilizumab (MRA) for binding to IL-6R; and a monovalent construct comprising an amino acid of the invention (and in particular a Nanobody) that is directed against an antigenic determinant or epitope on IL-6R that lies in, forms part of, or overlaps with (i.e. in the primary or tertiary structure) or is in close proximity to (i.e. in the primary or tertiary structure) the $D_2$ domain of IL-6R; and/or that is capable of specifically binding IL-6R as well as the hybrid IL-6R (as described in Example 3; SEQ ID NO: 131), as a binding domain or binding unit in providing and/or preparing a multiparatopic (such as biparatopic) construct, wherein the binding domains or binding units are linked via a linker such that the multiparatopic (such as biparatopic) construct preferably exhibits intramolecular binding compared to intermolecular binding.

In some of the most preferred multiparatopic, and preferably biparatopic polypeptides of the invention, (i) at least one monovalent construct (and in particular at least one Nanobody) is used that is directed against the Tocilizumab (MRA) binding site on IL-6R and/or that is capable of competing with Tocilizumab (MRA) for binding to IL-6R; and at least one amino acid sequence (and in particular at least one Nanobody) is used that is directed against an antigenic determinant or epitope on IL-6R that lies in, forms part of, or overlaps with (i.e. in the primary or tertiary structure) or is in close proximity to (i.e. in the primary or tertiary structure) the D3 domain of IL-6R; and/or that is capable of specifically binding IL-6R as well as the hybrid IL-6R (as described in Example 3; SEQ ID NO: 131). In such a preferred multiparatopic construct of the invention, the linker is most preferably such that the multiparatopic construct of the invention is capable of (simultaneously) binding to both the Tocilizumab (MRA) binding site on IL-6R as well as to the antigenic determinant or epitope on IL-6R that lies in, forms part of, or overlaps with (i.e. in the primary or tertiary structure) or is in close proximity to (i.e. in the primary or tertiary structure) the D3 domain of IL-6R, again most preferably so as to allow binding with increased avidity and also intramolecular binding and/or recognition. Accordingly, also encompassed in the present invention is the use of a monovalent construct comprising an amino acid of the invention (and in particular a Nanobody) that is directed against the Tocilizumab (MRA) binding site on IL-6R and/or that is capable of competing with Tocilizumab (MRA) for binding to IL-6R; and a monovalent construct comprising an amino acid of the invention (and in particular a Nanobody) that is directed against an antigenic determinant or epitope on IL-6R that lies in, forms part of, or overlaps with (i.e. in the primary or tertiary structure) or is in close proximity to (i.e. in the primary or tertiary structure) the D3 domain of IL-6R; and/or that is capable of specifically binding IL-6R as well as the hybrid IL-6R (as described in Example 3; SEQ ID NO: 131), as a binding domain or binding unit in providing and/or preparing a multiparatopic (such as biparatopic) construct, wherein the binding domains or binding units are linked via a linker such that the multiparatopic (such as biparatopic) construct preferably exhibits intramolecular binding compared to intermolecular binding.

In some of the most preferred multiparatopic, and preferably biparatopic polypeptides of the invention, (i) at least one monovalent construct (and in particular at least one Nanobody) is used that is directed against the M182 binding site on IL-6R and/or that is capable of competing with M182 for binding to IL-6R; and at least one amino acid sequence (and in particular at least one Nanobody) is used that is directed against an antigenic determinant or epitope on IL-6R that lies in, forms part of, or overlaps with (i.e. in the primary or tertiary structure) or is in close proximity to (i.e. in the primary or tertiary structure) the D1 domain of IL-6R; and/or that is capable of specifically binding IL-6R while not binding the hybrid IL-6R (as described in Example 3; SEQ ID NO: 131). In such a preferred multiparatopic construct of the invention, the linker is most preferably such that the multiparatopic construct of the invention is capable of (simultaneously) binding to both the M182 binding site on IL-6R as well as the antigenic determinant or epitope on IL-6R that lies in, forms part of, or overlaps with (i.e. in the primary or tertiary structure) or is in close proximity to (i.e. in the primary or tertiary structure) the D1 domain of IL-6R, again most preferably so as to allow binding with increased avidity and also intramolecular binding and/or recognition. Accordingly, also encompassed in the present invention is the use of a monovalent construct comprising an amino acid of the invention (and in particular a Nanobody) that is directed against the M182 binding site on IL-6R and/or that is capable of competing with M182 for binding to IL-6R; and a monovalent construct comprising an amino acid of the invention (and in particular a Nanobody) that is directed against an antigenic determinant or epitope on IL-6R that lies in, forms part of, or overlaps with (i.e. in the primary or tertiary structure) or is in close proximity to (i.e. in the primary or tertiary structure) the D1 domain of IL-6R; and/or that is capable of specifically binding IL-6R while not binding the hybrid IL-6R (as described in Example 3; SEQ ID NO: 131), as a binding domain or binding unit in providing and/or preparing a multiparatopic (such as biparatopic) construct, wherein the binding domains or binding units are linked via a linker such that the multiparatopic (such as biparatopic) construct preferably exhibits intramolecular binding compared to intermolecular binding.

In some of the most preferred multiparatopic, and preferably biparatopic polypeptides of the invention, (i) at least one monovalent construct (and in particular at least one Nanobody) is used that is directed against the M182 binding site on IL-6R and/or that is capable of competing with M182 for binding to IL-6R; and at least one amino acid sequence (and in particular at least one Nanobody) is used that is directed against an antigenic determinant or epitope on IL-6R that lies in, forms part of, or overlaps with (i.e. in the primary or tertiary structure) or is in close proximity to (i.e. in the primary or tertiary structure) the D2 domain of IL-6R; and/or that is capable of specifically binding IL-6R as well as the hybrid IL-6R (as described in Example 3; SEQ ID NO: 131). In such a preferred multiparatopic construct of the invention, the linker is most preferably such that the multiparatopic construct of the invention is capable of (simultaneously) binding to both the M182 binding site on IL-6R as well as the antigenic determinant or epitope on IL-6R that lies in, forms part of, or overlaps with (i.e. in the primary or tertiary structure) or is in close proximity to (i.e. in the primary or tertiary structure) the D2 domain of IL-6R, again most preferably so as to allow binding with increased avidity and also intramolecular binding and/or recognition. Accordingly, also encompassed in the present invention is the use of a monovalent construct comprising an amino acid of the invention (and in particular a Nanobody) that is directed against the M182 binding site on IL-6R and/or that is capable of competing with M182 for binding to IL-6R; and a monovalent construct comprising an amino acid of the invention (and in particular a Nanobody) that is directed against an antigenic determinant or epitope on IL-6R that lies in, forms part of, or overlaps with (i.e. in the primary or tertiary structure) or is in close proximity to (i.e. in the primary or tertiary structure) the D2 domain of IL-6R; and/or that is capable of specifically binding IL-6R as well as the hybrid IL-6R (as described in Example 3; SEQ ID NO: 131), as a binding domain or binding unit in providing and/or preparing a multiparatopic (such as biparatopic) construct, wherein the binding domains or binding units are linked via a linker such that the multiparatopic (such as biparatopic) construct preferably exhibits intramolecular binding compared to intermolecular binding.

In some of the most preferred multiparatopic, and preferably biparatopic polypeptides of the invention, (i) at least one monovalent construct (and in particular at least one Nanobody) is used that is directed against the M182 binding site on IL-6R and/or that is capable of competing with M182 for binding to IL-6R; and at least one amino acid sequence (and in particular at least one Nanobody) is used that is directed against an antigenic determinant or epitope on IL-6R that lies in, forms part of, or overlaps with (i.e. in the primary or tertiary structure) or is in close proximity to (i.e. in the primary or tertiary structure) the D3 domain of IL-6R; and/or that is capable of specifically binding IL-6R as well as the hybrid IL-6R (as described in Example 3; SEQ ID NO: 131). In such a preferred multiparatopic construct of the invention, the linker is most preferably such that the multiparatopic construct of the invention is capable of (simultaneously) binding to both the M182 binding site on IL-6R as well as the antigenic determinant or epitope on IL-6R that lies in, forms part of, or overlaps with (i.e. in the primary or tertiary structure) or is in close proximity to (i.e. in the primary or tertiary structure) the D3 domain of IL-6R, again most preferably so as to allow binding with increased avidity and also intramolecular binding and/or recognition. Accordingly, also encompassed in the present invention is the use of a monovalent construct comprising an amino acid of the invention (and in particular a Nanobody) that is directed against the M182 binding site on IL-6R and/or that is capable of competing with M182 for binding to IL-6R; and a monovalent construct comprising an amino acid of the invention (and in particular a Nanobody) that is directed against an antigenic determinant or epitope on IL-6R that lies in, forms part of, or overlaps with (i.e. in the primary or tertiary structure) or is in close proximity to (i.e. in the primary or tertiary structure) the D3 domain of IL-6R; and/or that is capable of specifically binding IL-6R as well as the hybrid IL-6R (as described in Example 3; SEQ ID NO: 131), as a binding domain or binding unit in providing and/or preparing a multiparatopic (such as biparatopic) construct, wherein the binding domains or binding units are linked via a linker such that the multiparatopic (such as biparatopic) construct preferably exhibits intramolecular binding compared to intermolecular binding.

In some of the most preferred multiparatopic, and preferably biparatopic polypeptides of the invention, (i) at least one monovalent construct (and in particular at least one Nanobody) is used that is directed against the BN-12 binding site on IL-6R and/or that is capable of competing with BN-12 for binding to IL-6R; and at least one amino acid sequence (and in particular at least one Nanobody) is used that is directed against an antigenic determinant or epitope on IL-6R that lies in, forms part of, or overlaps with (i.e. in the primary or tertiary structure) or is in close proximity to (i.e. in the primary or tertiary structure) the D1 domain of IL-6R; and/or that is capable of specifically binding IL-6R while not binding the hybrid IL-6R (as described in Example 3; SEQ ID NO: 131). In such a preferred multiparatopic construct of the invention, the linker is most preferably such that the multiparatopic construct of the invention is capable of (simultaneously) binding to both the BN-12 binding site on IL-6R as well as the antigenic determinant or epitope on IL-6R that lies in, forms part of, or overlaps with (i.e. in the primary or tertiary structure) or is in close proximity to (i.e.

in the primary or tertiary structure) the D1 domain of IL-6R, again most preferably so as to allow binding with increased avidity and also intramolecular binding and/or recognition. Accordingly, also encompassed in the present invention is the use of a monovalent construct comprising an amino acid of the invention (and in particular a Nanobody) that is directed against the BN-12 binding site on IL-6R and/or that is capable of competing with BN-12 for binding to IL-6R; and a monovalent construct comprising an amino acid of the invention (and in particular a Nanobody) that is directed against an antigenic determinant or epitope on IL-6R that lies in, forms part of, or overlaps with (i.e. in the primary or tertiary structure) or is in close proximity to (i.e. in the primary or tertiary structure) the D1 domain of IL-6R; and/or that is capable of specifically binding IL-6R while not binding the hybrid IL-6R (as described in Example 3; SEQ ID NO: 131), as a binding domain or binding unit in providing and/or preparing a multiparatopic (such as biparatopic) construct, wherein the binding domains or binding units are linked via a linker such that the multiparatopic (such as biparatopic) construct preferably exhibits intramolecular binding compared to intermolecular binding.

In some of the most preferred multiparatopic, and preferably biparatopic polypeptides of the invention, (i) at least one monovalent construct (and in particular at least one Nanobody) is used that is directed against the BN-12 binding site on IL-6R and/or that is capable of competing with BN-12 for binding to IL-6R; and at least one amino acid sequence (and in particular at least one Nanobody) is used that is directed against an antigenic determinant or epitope on IL-6R that lies in, forms part of, or overlaps with (i.e. in the primary or tertiary structure) or is in close proximity to (i.e. in the primary or tertiary structure) the D2 domain of IL-6R; and/or that is capable of specifically binding IL-6R as well as the hybrid IL-6R (as described in Example 3; SEQ ID NO: 131). In such a preferred multiparatopic construct of the invention, the linker is most preferably such that the multiparatopic construct of the invention is capable of (simultaneously) binding to both the BN-12 binding site on IL-6R as well as the antigenic determinant or epitope on IL-6R that lies in, forms part of, or overlaps with (i.e. in the primary or tertiary structure) or is in close proximity to (i.e. in the primary or tertiary structure) the D2 domain of IL-6R, again most preferably so as to allow binding with increased avidity and also intramolecular binding and/or recognition. Accordingly, also encompassed in the present invention is the use of a monovalent construct comprising an amino acid of the invention (and in particular a Nanobody) that is directed against the BN-12 binding site on IL-6R and/or that is capable of competing with BN-12 for binding to IL-6R; and a monovalent construct comprising an amino acid of the invention (and in particular a Nanobody) that is directed against an antigenic determinant or epitope on IL-6R that lies in, forms part of, or overlaps with (i.e. in the primary or tertiary structure) or is in close proximity to (i.e. in the primary or tertiary structure) the D2 domain of IL-6R; and/or that is capable of specifically binding IL-6R as well as the hybrid IL-6R (as described in Example 3; SEQ ID NO: 131), as a binding domain or binding unit in providing and/or preparing a multiparatopic (such as biparatopic) construct, wherein the binding domains or binding units are linked via a linker such that the multiparatopic (such as biparatopic) construct preferably exhibits intramolecular binding compared to intermolecular binding.

In some of the most preferred multiparatopic, and preferably biparatopic polypeptides of the invention, (i) at least one monovalent construct (and in particular at least one Nanobody) is used that is directed against the BN-12 binding site on IL-6R and/or that is capable of competing with BN-12 for binding to IL-6R; and at least one amino acid sequence (and in particular at least one Nanobody) is used that is directed against an antigenic determinant or epitope on IL-6R that lies in, forms part of, or overlaps with (i.e. in the primary or tertiary structure) or is in close proximity to (i.e. in the primary or tertiary structure) the D3 domain of IL-6R; and/or that is capable of specifically binding IL-6R as well as the hybrid IL-6R (as described in Example 3; SEQ ID NO: 131). In such a preferred multiparatopic construct of the invention, the linker is most preferably such that the multiparatopic construct of the invention is capable of (simultaneously) binding to both the BN-12 binding site on IL-6R as well as the antigenic determinant or epitope on IL-6R that lies in, forms part of, or overlaps with (i.e. in the primary or tertiary structure) or is in close proximity to (i.e. in the primary or tertiary structure) the D3 domain of IL-6R, again most preferably so as to allow binding with increased avidity and also intramolecular binding and/or recognition. Accordingly, also encompassed in the present invention is the use of a monovalent construct comprising an amino acid of the invention (and in particular a Nanobody) that is directed against the BN-12 binding site on IL-6R and/or that is capable of competing with BN-12 for binding to IL-6R; and a monovalent construct comprising an amino acid of the invention (and in particular a Nanobody) that is directed against an antigenic determinant or epitope on IL-6R that lies in, forms part of, or overlaps with (i.e. in the primary or tertiary structure) or is in close proximity to (i.e. in the primary or tertiary structure) the D3 domain of IL-6R; and/or that is capable of specifically binding IL-6R as well as the hybrid IL-6R (as described in Example 3; SEQ ID NO: 131), as a binding domain or binding unit in providing and/or preparing a multiparatopic (such as biparatopic) construct, wherein the binding domains or binding units are linked via a linker such that the multiparatopic (such as biparatopic) construct preferably exhibits intramolecular binding compared to intermolecular binding.

In some of the most preferred multiparatopic, and preferably biparatopic polypeptides of the invention, (i) at least one monovalent construct (and in particular at least one Nanobody) is used that is directed against the IL-6 binding site on IL-6R (and in particular one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or that is capable of competing with IL-6 for binding to IL-6R; and at least one monovalent construct (and in particular at least one Nanobody) is used that is directed against the gp130 binding site on IL-6R and/or the IL-6/IL-6R complex and/or that is capable of competing with gp130 for binding to the IL-6/IL-6R complex. In such a preferred multiparatopic construct of the invention, the linker is most preferably such that the multiparatopic construct of the invention is capable of (simultaneously) binding to both the IL-6 binding site on IL-6R (and in particular one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) as well as the gp130 binding site on IL-6R and/or the IL-6/IL-6R complex, again most preferably so as to allow binding with increased avidity and also intramolecular binding and/or recognition. Accordingly, also encompassed in the present invention is the use of a monovalent construct comprising an amino acid sequence (and in particular a Nanobody) that is directed against the IL-6 binding site on IL-6R (and in particular one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or that is capable of competing with IL-6 for binding to IL-6R, and a monovalent construct comprising an amino acid sequence (and in particular a Nanobody) that is directed against the gp130 binding site on IL-6R and/or the IL-6/IL-6R complex and/or that is capable of competing with gp130 for binding to the IL-6/IL-6R complex, as binding domains or binding units in providing and/or preparing a multiparatopic (such as a biparatopic) construct, wherein the binding domains or binding units are linked via a linker such that the multiparatopic (such as biparatopic) construct preferably exhibits intramolecular binding compared to intermolecular binding.

In some of the most preferred multiparatopic polypeptides of the invention, (i) at least one monovalent construct (and in particular at least one Nanobody) is used that is directed against the Tocilizumab (MRA) binding site on IL-6R and/or that is capable of competing with Tocilizumab (MRA) for binding to IL-6R; and at least one monovalent construct (and in particular at least one Nanobody) is used that is directed against the gp130 binding site on IL-6R and/or the IL-6/IL-6R complex and/or that is capable of competing with gp130 for binding to the IL-6/IL-6R complex. In such a preferred multiparatopic construct of the invention, the linker is most preferably such that the multiparatopic construct of the invention is capable of (simultaneously) binding to both the Tocilizumab (MRA) binding site on IL-6R as well as the gp130 binding site on IL-6R and/or the IL-6/IL-6R complex, again most preferably so as to allow binding with increased avidity and also intramolecular binding and/or recognition. Accordingly, also encompassed in the present invention is the use of a monovalent construct comprising an amino acid sequence (and in particular a Nanobody) that is directed against the Tocilizumab (MRA) binding site on IL-6R and/or that is capable of competing with Tocilizumab (MRA) for binding to IL-6R, and a monovalent construct comprising an amino acid sequence (and in particular a Nanobody) that is directed against the gp130 binding site on IL-6R and/or the IL-6/IL-6R complex and/or that is capable of competing with gp130 for binding to the IL-6/IL-6R complex, as binding domains or binding units in providing and/or preparing a multiparatopic (such as a biparatopic) construct, wherein the binding domains or binding units are linked via a linker such that the multiparatopic (such as biparatopic) construct preferably exhibits intramolecular binding compared to intermolecular binding.

In some of the most preferred multiparatopic polypeptides of the invention, (i) at least one monovalent construct (and in particular at least one Nanobody) is used that is directed against the BN-12 binding site on IL-6R and/or that is capable of competing with BN-12 for binding to IL-6R; and at least one monovalent construct (and in particular at least one Nanobody) is used that is directed against the gp130 binding site on IL-6R and/or the IL-6/IL-6R complex and/or that is capable of competing with gp130 for binding to the IL-6/IL-6R complex. In such a preferred multiparatopic construct of the invention, the linker is most preferably such that the multiparatopic construct of the invention is capable of (simultaneously) binding to both the BN-12 binding site on IL-6R as well as the gp130 binding site on IL-6R and/or the IL-6/IL-6R complex, again most preferably so as to allow binding with increased avidity and also intramolecular binding and/or recognition. Accordingly, also encompassed in the present invention is the use of a monovalent construct comprising an amino acid sequence (and in particular a Nanobody) that is directed against the BN-12 binding site on IL-6R and/or that is capable of competing with BN-12 for binding to IL-6R, and a monovalent construct comprising an amino acid sequence (and in particular a Nanobody) that is directed against the gp130 binding site on IL-6R and/or the IL-6/IL-6R complex and/or that is capable of competing with gp130 for binding to the IL-6/IL-6R complex, as binding domains or binding units in providing and/or preparing a multiparatopic (such as a biparatopic) construct, wherein the binding domains or binding units are linked via a linker such that the multiparatopic (such as biparatopic) construct preferably exhibits intramolecular binding compared to intermolecular binding.

In some of the most preferred multiparatopic polypeptides of the invention, (i) at least one monovalent construct (and in particular at least one Nanobody) is used that is directed against the IL-6 binding site on IL-6R (and in particular one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or that is capable of competing with IL-6 for binding to IL-6R; and at least one monovalent construct (and in particular at least one Nanobody) is used that is directed against the M182 binding site on IL-6R and/or that is capable of competing with M182 for binding to IL-6R. In such a preferred multiparatopic construct of the invention, the linker is most preferably such that the multiparatopic construct of the invention is capable of (simultaneously) binding to both the IL-6 binding site on IL-6R (and in particular one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) as well as the M182 binding site on IL-6R, again most preferably so as to allow binding with increased avidity and also intramolecular binding and/or recognition. Accordingly, also encompassed in the present invention is the use of a monovalent construct comprising an amino acid sequence (and in particular a Nanobody) that is directed against the IL-6 binding site on IL-6R (and in particular one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or that is capable of competing with IL-6 for binding to IL-6R, and a monovalent construct comprising an amino acid sequence (and in particular a Nanobody) that is directed against the M182 binding site on IL-6R and/or that is capable of competing with M182 for binding to IL-6R, as binding domains or binding units in providing and/or preparing a multiparatopic (such as a biparatopic) construct, wherein the binding domains or binding units are linked via a linker such that the multiparatopic (such as biparatopic) construct preferably exhibits intramolecular binding compared to intermolecular binding.

In some of the most preferred multiparatopic polypeptides of the invention, (i) at least one monovalent construct (and in particular at least one Nanobody) is used that is directed against the IL-6 binding site on IL-6R (and in particular one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or that is capable of competing with IL-6 for binding to IL-6R; and at least one monovalent construct (and in particular at least one Nanobody) is used that is directed against the BN-12 binding site on IL-6R and/or that is capable of competing with BN-12 for binding to IL-6R. In such a preferred multiparatopic construct of the invention, the linker is most preferably such that the multiparatopic construct of the invention is capable of (simultaneously) binding to both the IL-6 binding site on IL-6R (and in particular one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) as well as the BN-12 binding site on IL-6R, again most preferably so as to allow binding with increased avidity and also intramolecular binding and/or recognition. Accordingly, also encompassed in the present invention is the use of a monovalent construct comprising an amino acid sequence (and in particular a Nanobody) that is directed against the IL-6 binding site on IL-6R (and in particular one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or that is capable of competing with IL-6 for binding to IL-6R, and a monovalent construct comprising an amino acid sequence (and in particular a Nanobody) that is directed against the BN-12 binding site on IL-6R and/or that is capable of competing with BN-12 for binding to IL-6R, as binding domains or binding units in providing and/or preparing a multiparatopic (such as a biparatopic) construct, wherein the binding domains or binding units are linked via a linker such that the multiparatopic (such as biparatopic) construct preferably exhibits intramolecular binding compared to intermolecular binding.

In some of the most preferred multiparatopic polypeptides of the invention, (i) at least one monovalent construct (and in particular at least one Nanobody) is used that is directed against the Tocilizumab (MRA) binding site on IL-6R and/or that is capable of competing with Tocilizumab (MRA) for binding to IL-6R; and at least one monovalent construct (and in particular at least one Nanobody) is used that is directed against the M182 binding site on IL-6R and/or that is capable of competing with M182 for binding to IL-6R. In such a preferred multiparatopic construct of the invention, the linker is most preferably such that the multiparatopic construct of the invention is capable of (simultaneously) binding to both the Tocilizumab (MRA) binding site on IL-6R as well as the M182 binding site on IL-6R, again most preferably so as to allow binding with increased avidity and also intramolecular binding and/or recognition. Accordingly, also encompassed in the present invention is the use of a monovalent construct comprising an amino acid sequence (and in particular a Nanobody) that is directed against the Tocilizumab (MRA) binding site on IL-6R and/or that is capable of competing with Tocilizumab (MRA) for binding to IL-6R, and a monovalent construct comprising an amino acid sequence (and in particular a Nanobody) that is directed against the M182 binding site on IL-6R and/or that is capable of competing with M182 for binding to IL-6R, as binding domains or binding units in providing and/or preparing a multiparatopic (such as a biparatopic) construct, wherein the binding domains or binding units are linked via a linker such that the multiparatopic (such as biparatopic) construct preferably exhibits intramolecular binding compared to intermolecular binding.

In some of the most preferred multiparatopic polypeptides of the invention, (i) at least one monovalent construct (and in particular at least one Nanobody) is used that is directed against the Tocilizumab (MRA) binding site on IL-6R and/or that is capable of competing with Tocilizumab (MRA) for binding to IL-6R; and at least one monovalent construct (and in particular at least one Nanobody) is used that is directed against the BN-12 binding site on IL-6R and/or that is capable of competing with BN-12 for binding to IL-6R. In such a preferred multiparatopic construct of the invention, the linker is most preferably such that the multiparatopic construct of the invention is capable of (simultaneously) binding to both the Tocilizumab (MRA) binding site on IL-6R as well as the BN-12 binding site on IL-6R, again most preferably so as to allow binding with increased avidity and also intramolecular binding and/or recognition. Accordingly, also encompassed in the present invention is the use of a monovalent construct comprising an amino acid sequence (and in particular a Nanobody) that is directed against the Tocilizumab (MRA) binding site on IL-6R and/or that is capable of competing with Tocilizumab (MRA) for binding to IL-6R, and a monovalent construct comprising an amino acid sequence (and in particular a Nanobody) that is directed against the BN-12 binding site on IL-6R and/or that is capable of competing with BN-12 for binding to IL-6R, as binding domains or binding units in providing and/or preparing a multiparatopic (such as a biparatopic) construct, wherein the binding domains or binding units are linked via a linker such that the multiparatopic (such as biparatopic) construct preferably exhibits intramolecular binding compared to intermolecular binding.

In some of the most preferred multiparatopic polypeptides of the invention, (i) at least one monovalent construct (and in particular at least one Nanobody) is used that is directed against the BN-12 binding site on IL-6R and/or that is capable of competing with BN-12 for binding to IL-6R; and at least one monovalent construct (and in particular at least one Nanobody) is used that is directed against the M182 binding site on IL-6R and/or that is capable of competing with M182 for binding to IL-6R. In such a preferred multiparatopic construct of the invention, the linker is most preferably such that the multiparatopic construct of the invention is capable of (simultaneously) binding to both the BN-12 binding site on IL-6R as well as the M182 binding site on IL-6R, again most preferably so as to allow binding with increased avidity and also intramolecular binding and/or recognition. Accordingly, also encompassed in the present invention is the use of a monovalent construct comprising an amino acid sequence (and in particular a Nanobody) that is directed against the BN-12 binding site on IL-6R and/or that is capable of competing with BN-12 for binding to IL-6R, and a monovalent construct comprising an amino acid sequence (and in particular a Nanobody) that is directed against the M182 binding site on IL-6R and/or that is capable of competing with M182 for binding to IL-6R, as binding domains or binding units in providing and/or preparing a multiparatopic (such as a biparatopic) construct, wherein the binding domains or binding units are linked via a linker such that the multiparatopic (such as biparatopic) construct preferably exhibits intramolecular binding compared to intermolecular binding.

In a preferred aspect the monovalent constructs, amino acid sequences and/or Nanobodies used in the preparation of the multiparatopic, and preferably biparatopic polypeptides of the invention are monovalent constructs, amino acid sequences and/or Nanobodies of the invention as described herein. More preferably, the monovalent constructs, amino acid sequences and/or Nanobodies used in the preparation of the multiparatopic, and preferably biparatopic polypeptides of the invention are selected from SEQ ID NO's: 132-215. Accordingly, in some of the most preferred multiparatopic, and preferably biparatopic polypeptides of the invention, (i) at least one monovalent construct (and in particular at least one Nanobody) is used that is selected from SEQ ID NO's: 132-216; and at least one amino acid sequence (and in particular at least one Nanobody) is used that is directed against another antigenic determinant, epitope, part or domain of IL-6R. In such a preferred multiparatopic construct of the invention, the linker is most preferably such that the multiparatopic construct of the invention is capable of (simultaneously) binding to both the binding site on IL-6R for the amino acid sequence selected from SEQ ID NO's: 132-216 as well as to the other antigenic determinant, epitope, part or domain of IL-6R, again most preferably so as to allow binding with increased avidity and also intramolecular binding and/or recognition. Accordingly, also encompassed in the present invention is the use of a monovalent construct comprising an amino acid of the invention (and in particular a Nanobody) selected from SEQ ID NO's: 132-216, as a binding domain or binding unit in providing and/or preparing a multiparatopic (such as biparatopic) construct, wherein the binding domains or binding units are linked via a linker such that the multiparatopic (such as biparatopic) construct preferably exhibits intramolecular binding compared to intermolecular binding.

The present invention also relates to the use of a nucleic acid or nucleotide sequence that encodes a monovalent construct of the invention for the preparation of a genetic construct (as further defined herein) that encodes a multivalent (such as multiparatopic, and preferably biparatopic) construct. Also, as will be clear to the skilled person, to prepare such a genetic construct, encoding a multivalent (such as multiparatopic, and preferably biparatopic) construct of the invention, several nucleotide sequences, such as at least two nucleotide sequences encoding a monovalent construct of the invention and for example nucleic acids encoding one or more linkers can be linked together in a suitable manner. Such genetic constructs generally also comprises one or more elements of genetic constructs known per se, such as for example one or more suitable regulatory elements (such as a suitable promoter(s), enhancer(s), terminator(s), etc.) and the further elements of genetic constructs referred to herein.

Techniques for generating the nucleic acids of the invention will be clear to the skilled person and may for instance include, but are not limited to, automated DNA synthesis; site-directed mutagenesis; combining two or more naturally occurring and/or synthetic sequences (or two or more parts thereof), introduction of mutations that lead to the expression of a truncated expression product; introduction of one or more restriction sites (e.g. to create cassettes and/or regions that may easily be digested and/or ligated using suitable restriction enzymes), and/or the introduction of mutations by means of a PCR reaction using one or more "mismatched" primers. These and other techniques will be clear to the skilled person, and reference is again made to the standard handbooks, such as Sambrook et al. and Ausubel et al., mentioned above, as well as the Examples below.

In the above constructs, the one or more Nanobodies and/or other amino acid sequences may be directly linked to each other and/or suitably linked to each other via one or more linker sequences. Some suitable but non-limiting examples of such linkers will become clear from the further description herein.

It is encompassed within the scope of the invention that the length, the degree of flexibility and/or other properties of the linker(s) used (although not critical, as it usually is for linkers used in ScFv fragments) may have some influence on the properties of the final polypeptide of the invention, including but not limited to the affinity, specificity or avidity for IL-6R. Based on the disclosure herein, the skilled person will be able to determine the optimal linker(s) for use in a specific multiparatopic (preferably biparatopic) polypeptide of the invention, optionally after some limited routine experiments.

In the multiparatopic (preferably biparatopic) polypeptide of the invention that comprises Nanobodies directed against two or more (preferably two) different antigenic determinants on IL-6R (for example against different epitopes of IL-6R), the length and flexibility of the linker are preferably such that, when the multiparatopic (preferably biparatopic) polypeptide binds to IL-6R, at least two and preferably all of the Nanobodies that are present in the multiparatopic (preferably biparatopic) polypeptide can (simultaneously) bind to each of their intended antigenic determinants, epitopes, parts or domains, most preferably so as to allow binding with increased avidity and also intramolecular binding and/or recognition. Again, based on the disclosure herein, the skilled person will be able to determine the optimal linker(s) for use in a specific polypeptide of the invention, optionally after some limited routine experiments.

For example, as further described herein, some of the most preferred multiparatopic (preferably biparatopic) polypeptides of the invention comprise (i) at least one amino acid sequence (and in particular at least one Nanobody) that is directed against the IL-6 binding site on IL-6R (and in particular one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or that is capable of competing with IL-6 for binding to IL-6R; and at least one amino acid sequence (and in particular at least one Nanobody) that is directed against the gp130 binding site on IL-6R and/or the IL-6/IL-6R complex and/or that is capable of competing with gp130 for binding to the IL-6/IL-6R complex. In such a preferred multiparatopic (preferably biparatopic) polypeptide of the invention, the linker is most preferably such that the multiparatopic (preferably biparatopic) polypeptide of the invention is capable of (simultaneously) binding to both the IL-6 binding site on IL-6R (and in particular one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) as well as the gp130 binding site on IL-6R and/or the IL-6/IL-6R complex, again most preferably so as to allow binding with increased avidity and also intramolecular binding and/or recognition. Such multiparatopic (preferably biparatopic) polypeptides of the invention with such a linker form a particularly preferred aspect of the invention, and examples of such a linker are given in the Examples below. For example, when such a linker is a Gly-Ser linker (for example, a Gly-Ser linker as described in the Examples), it preferably has a length of at least 8 or 9 amino acid residues, such as at least 10, at least 15, at least 20 or at least 30 or 35 amino acid residues. The maximum length is not especially critical, but for practical considerations (such as ease of cloning and expression) the linker is preferably no longer than 75 amino acid residues, more preferably less than 50 amino acid residues. For example, Gly-Ser linkers (such as the Gly-Ser linkers as described in the Examples) of between 20 and 40 amino acid residues, such as about 25, 30 or 35 amino acid residues, may be particularly suited. Based on the disclosure herein, the skilled person will be able to determine other suitable linkers, it being understood that the optimal length of each linker may also depend on the amino acid composition of the linker that is envisaged for use. Some preferred linkers for use in the polypeptides of the invention are given in SEQ ID NO's: 951-956 (Table A-8).

Optimal linker lengths in biparatopic, triparatopic or multiparatopic polypeptides of the invention can, for example, be designed in silico with any method for protein design known in the art or disclosed herein. Optimal linker lengths, for example obtained by in silico design, can further be verified experimentally by binding and competition assays as will be known to the skilled person and/or described herein. Optimal linker lengths in biparatopic, triparatopic or multiparatopic polypeptides may also be determined using the screening method for determining optimal linker length as described herein.

The choice of linker length in biparatopic, triparatopic or multiparatopic polypeptides of the invention can also be such that only a limited epitope space on the antigen is covered. Linker length restriction can, for example, help to avoid targeting epitopes which should not be neutralized (e.g. those essential for a function of the antigen) or to target regions relatively adjacent to a first 'guiding' Nanobody.

The choice of the format (N- or C-terminal position of the different Nanobodies) of the biparatopic, triparatopic or multiparatopic polypeptides of the invention and linker length can also be used to obtain molecules that bind avidly to the target antigen (via two, or more, binding sites), yet are purposely not agonistic. By optimising the format and linker length and composition, the binding sites can be positioned in such way that simultaneous binding of two or more Nanobodies to the same target antigen (i.e. intramolecular binding) will be highly favoured compared to binding to separate antigens in proximity of one another.

It is also within the scope of the invention that the linker(s) used confer one or more other favourable properties or functionality to the polypeptides of the invention, and/or provide one or more sites for the formation of derivatives and/or for the attachment of functional groups (e.g. as described herein for the derivatives of the Nanobodies of the invention). For example, linkers containing one or more charged amino acid residues (see Table A-2 above) can provide improved hydrophilic properties, whereas linkers that form or contain small epitopes or tags can be used for the purposes of detection, identification and/or purification. Again, based on the disclosure herein, the skilled person will be able to determine the optimal linkers for use in a specific polypeptide of the invention, optionally after some limited routine experiments.

Finally, when two or more linkers are used in the polypeptides of the invention, these linkers may be the same or different. Again, based on the disclosure herein, the skilled person will be able to determine the optimal linkers for use in a specific polypeptide of the invention, optionally after some limited routine experiments.

Usually, for easy of expression and production, a polypeptide of the invention will be a linear polypeptide. However, the invention in its broadest sense is not limited thereto. For example, when a polypeptide of the invention comprises three of more Nanobodies, it is possible to link them by use of a linker with three or more "arms", which each "arm" being linked to an amino acid sequence or Nanobody, so as to provide a "star-shaped" construct. It is also possible, although usually less preferred, to use circular constructs.

In one specific aspect of the invention, a biparatopic (or multiparatopic) polypeptide of the invention, an amino acid sequence of the invention, a Nanobody of the invention or a compound, construct or polypeptide of the invention comprising at least one Nanobody of the invention may have an increased half-life, compared to the corresponding biparatopic (or multiparatopic) polypeptide, amino acid sequence or Nanobody. Some preferred, but non-limiting examples of such biparatopic (or multiparatopic) polypeptides, amino acid sequences or Nanobodies, compounds and polypeptides of the invention will become clear to the skilled person based on the further disclosure herein, and for example comprise biparatopic (or multiparatopic) polypeptides of the invention, amino acid sequences of the invention or Nanobodies of the invention that have been chemically modified to increase the half-life thereof (for example, by means of pegylation); biparatopic (or multiparatopic) polypeptides of the invention, amino acid sequences of the invention or Nanobodies of the invention that comprise at least one additional binding site for binding to a serum protein (such as serum albumin, see for example EP 0 368 684 B1, page 4); or biparatopic (or multiparatopic) polypeptides of the invention, amino acid sequences of the invention or Nanobodies of the invention that comprise at least one biparatopic (or multiparatopic) polypeptide of the invention, amino acid sequence of the invention or Nanobody of the invention of the invention that is linked to at least one moiety (and in particular at least one amino acid sequence) that increases the half-life of the biparatopic (or multiparatopic) polypeptide of the invention, amino acid sequence of the invention or Nanobody of the invention. Examples of biparatopic (or multiparatopic) polypeptides of the invention, amino acid sequences of the invention or Nanobodies of the invention that comprise such half-life extending moieties or amino acid sequences will become clear to the skilled person based on the further disclosure herein; and for example include, without limitation, biparatopic (or multiparatopic) polypeptides of the invention, amino acid sequences of the invention or Nanobodies of the invention which are suitable linked to one or more serum proteins or fragments thereof (such as serum albumin or suitable fragments thereof) or to one or more binding units that can bind to serum proteins (such as, for example, Nanobodies or (single) domain antibodies that can bind to serum proteins such as serum albumin, serum immunoglobulins such as IgG, or transferrine); biparatopic (or multiparatopic) polypeptides of the invention, amino acid sequences of the invention or Nanobodies of the invention linked to an Fc portion (such as a human Fc) or a suitable part or fragment thereof; or biparatopic (or multiparatopic) polypeptides of the invention, amino acid sequences of the invention or Nanobodies of the invention that are suitable linked to one or more small proteins or peptides that can bind to serum proteins (such as, without limitation, the proteins and peptides described in WO 91/01743, WO 01/45746, WO 02/076489 and to WO 2008/068280.

Again, as will be clear to the skilled person, such biparatopic (or multiparatopic) polypeptides, amino acid sequences, Nanobodies, compounds, constructs or polypeptides may contain one or more additional groups, residues, moieties or binding units, such as one or more further amino acid sequences and in particular one or more additional Nanobodies (i.e. not directed against IL-6R), so as to provide a tri- of multispecific Nanobody construct.

Generally, the biparatopic (or multiparatopic) polypeptides of the invention, amino acid sequences of the invention or Nanobody of the invention (or compounds, constructs or polypeptides comprising the same) with increased half-life preferably have a half-life that is at least 1.5 times, preferably at least 2 times, such as at least 5 times, for example at least 10 times or more than 20 times, greater than the half-life of the corresponding biparatopic (or multiparatopic) polypeptide of the invention per se, amino acid sequence of the invention per se or Nanobody of the invention per se. For example, the biparatopic (or multiparatopic) polypeptides, amino acid sequences, Nanobodies, compounds, constructs or polypeptides of the invention with increased half-life may have a half-life that is increased with more than 1 hours, preferably more than 2 hours, more preferably more than 6 hours, such as more than 12 hours, or even more than 24, 48 or 72 hours, compared to the corresponding biparatopic (or multiparatopic) polypeptide of the invention per se, amino acid sequence of the invention per se or Nanobody of the invention per se.

In a preferred, but non-limiting aspect of the invention, such biparatopic (or multiparatopic) polypeptides of the invention, amino acid sequences of the invention or Nanobodies of the invention, compounds, constructs or polypeptides of the invention exhibit a serum half-life in human of at least about 12 hours, preferably at least 24 hours, more preferably at least 48 hours, even more preferably at least 72 hours or more. For example, biparatopic (or multiparatopic) polypeptides of the invention, amino acid sequences of the invention, Nanobodies of the invention, compounds or polypeptides of the invention may have a half-life of at least 5 days (such as about 5 to 10 days), preferably at least 9 days (such as about 9 to 14 days), more preferably at least about 10 days (such as about 10 to 15 days), or at least about 11 days (such as about 11 to 16 days), more preferably at least about 12 days (such as about 12 to 18 days or more), or more than 14 days (such as about 14 to 19 days).

In another aspect of the invention, a biparatopic (or multiparatopic) polypeptide of the invention, amino acid sequence of the invention or Nanobody of the invention (or compounds, constructs or polypeptides comprising the same) is linked (optionally via one or more suitable linker sequences) to one or more (such as two and preferably one) amino acid sequences that allow the resulting polypeptide of the invention to cross the blood brain barrier. In particular, said one or more amino acid sequences that allow the resulting polypeptides of the invention to cross the blood brain barrier may be one or more (such as two and preferably one) Nanobodies, such as the Nanobodies described in WO 02/057445, of which FC44 (SEQ ID NO: 189 of WO 06/040153) and FC5 (SEQ ID NO: 190 of WO 06/040154) are preferred examples.

In particular, polypeptides comprising one or more biparatopic (or multiparatopic) polypeptides of the invention, amino acid sequences of the invention or Nanobodies of the invention (or compounds, constructs or polypeptides comprising the same) are preferably such that they:
 bind to IL-6R with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles);

and/or such that they:
 bind to IL-6R with a $k_{on}$-rate of between $10^2$ $M^{-1}s^{-1}$ to about $10^7$ $M^{-1}s^{-1}$, preferably between $10^3$ $M^{-1}s^4$ and $10^7$ $M^{-1}s^{-1}$, more preferably between $10^4$ $M^{-1}s^4$ and $10^7$ $M^{-1}s^{-1}$, such as between $10^5$ $M^{-1}s^{-1}$ and $10^7$ $M^{-1}s^{-1}$;

and/or such that they:
 bind to IL-6R with a $k_{off}$ rate between 1 $s^{-1}$ ($t_{1/2}$=0.69 s) and $10^{-6}$ $s^{-1}$ (providing a near irreversible complex with a $t_{1/2}$ of multiple days), preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Preferably, a polypeptide that contains only one amino acid sequence of the invention is preferably such that it will bind to IL-6R with an affinity less than 500 nM, preferably less than 200 nM, more preferably less than 10 nM, such as less than 500 μM. In this respect, it will be clear to the skilled person that a polypeptide that contains two or more Nanobodies of the invention may bind to IL-6R with an increased avidity, compared to a polypeptide that contains only one amino acid sequence of the invention.

Some preferred $IC_{50}$ values for binding of the amino acid sequences or polypeptides of the invention to IL-6R will become clear from the further description and examples herein.

Other polypeptides according to this preferred aspect of the invention may for example be chosen from the group consisting of amino acid sequences that have more than 80%, preferably more than 90%, more preferably more than 95%, such as 99% or more "sequence identity" (as defined herein) with one or more of the amino acid sequences of SEQ ID NO's: 812-947] (see Tables A-4 to A-6), in which the Nanobodies comprised within said polypeptides are preferably as further defined herein.

Another aspect of this invention relates to a nucleic acid that encodes an amino acid sequence of the invention (such as a Nanobody of the invention) or a polypeptide of the invention comprising the same. Again, as generally described herein for the nucleic acids of the invention, such a nucleic acid may be in the form of a genetic construct, as defined herein.

In another aspect, the invention relates to host or host cell that expresses or that is capable of expressing an amino acid sequence (such as a Nanobody) of the invention and/or a polypeptide of the invention comprising the same; and/or that contains a nucleic acid of the invention. Some preferred but non-limiting examples of such hosts or host cells will become clear from the further description herein.

Another aspect of the invention relates to a product or composition containing or comprising at least one amino acid sequence and/or Nanobody of the invention, at least one polypeptide of the invention and/or at least one nucleic acid of the invention, and optionally one or more further components of such compositions known per se, i.e. depending on the intended use of the composition. Such a product or composition may for example be a pharmaceutical composition (as described herein), a veterinary composition or a product or composition for diagnostic use (as also described herein). Some preferred but non-limiting examples of such products or compositions will become clear from the further description herein.

The invention further relates to methods for preparing or generating the amino acid sequences, compounds, constructs, polypeptides, nucleic acids, host cells, products and compositions described herein. Some preferred but non-limiting examples of such methods will become clear from the further description herein.

Especially encompassed within the present invention are methods for preparing and generating multiparatopic (such as e.g. biparatopic, triparatopic, etc.) polypeptides of the invention.

Without being limiting, a method for preparing and generating biparatopic polypeptides of the invention may comprise at least the steps of:

a) providing a nucleic acid sequence encoding an IL-6R binding amino acid sequence fused to a set, collection or library of nucleic acid sequences encoding amino acid sequences;

b) screening said set, collection or library of nucleic acid sequences for nucleic acid sequences that encode an amino acid sequence that can bind to and/or has affinity for an antigenic determinant on IL-6R different from the antigenic determinant recognized by the IL-6R binding amino acid sequence;

and c) isolating the nucleic acid sequence encoding the IL-6R binding amino acid sequence fused to the nucleic acid sequence obtained in b), followed by expressing the encoded amino acid sequence.

The nucleic acid sequence encoding the biparatopic polypeptide obtained in the method above, can subsequently be fused to one or more further sets, collections or libraries of nucleic acid sequences encoding amino acid sequences and again screened for nucleic acid sequences that encode an amino acid sequence that can bind to and/or has affinity for an antigenic determinant on IL-6R different from the antigenic determinant of the IL-6R binding amino acid sequence and the antigenic determinant of b) in order to obtain a triparatopic or multiparatopic amino acid sequence respectively.

In such a method, the set, collection or library of nucleic acid sequences encoding amino acid sequences may for example be a set, collection or library of nucleic acid sequences encoding a naïve set, collection or library of immunoglobulin sequences; a set, collection or library of nucleic acid sequences encoding a synthetic or semi-synthetic set, collection or library of immunoglobulin sequences; and/or a set, collection or library of nucleic acid sequences encoding a set, collection or library of immunoglobulin sequences that have been subjected to affinity maturation.

Also, in such a method, the set, collection or library of nucleic acid sequences may encode a set, collection or library of heavy chain variable domains (such as $V_H$ domains or $V_{HH}$ domains) or of light chain variable domains. For example, the set, collection or library of nucleic acid sequences may encode a set, collection or library of domain antibodies or single domain antibodies, or a set, collection or library of amino acid sequences that are capable of functioning as a domain antibody or single domain antibody.

In a preferred aspect of this method, the set, collection or library of nucleic acid sequences may be an immune set, collection or library of nucleic acid sequences, for example derived from a mammal that has been suitably immunized with IL-6R or with a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

The set, collection or library of nucleic acid sequences may for example encode an immune set, collection or library of heavy chain variable domains or of light chain variable domains. In one specific aspect, the set, collection or library of nucleotide sequences may encode a set, collection or library of $V_{HH}$ sequences.

In the above methods, the nucleic acid sequence encoding an IL-6R binding amino acid sequence fused to the set, collection or library of nucleotide sequences may be displayed on a phage, phagemid, ribosome or suitable microorganism (such as yeast), such as to facilitate screening. Suitable methods, techniques and host organisms for displaying and screening (a set, collection or library of) nucleotide sequences encoding amino acid sequences will be clear to the person skilled in the art, for example on the basis of the further disclosure herein. Reference is also made to the review by Hoogenboom in Nature Biotechnology, 23, 9, 1105-1116 (2005).

According to a particularly preferred aspect, a method for preparing and generating biparatopic polypeptides of the invention may comprise at least the steps of:

a) providing a set, collection or library of nucleic acid sequences, in which each nucleic acid sequence in said set, collection or library encodes a fusion protein that comprises a first amino acid sequence that can bind to and/or has affinity for a first antigenic determinant, part, domain or epitope on IL-6R that is fused (optionally via a linker sequence) to a second amino acid sequence, in which essentially each second amino acid sequence (or most of these) is a different member of a set, collection or library of different amino acid sequences;

b) screening said set, collection or library of nucleic acid sequences for nucleic acid sequences that encode an amino acid sequence that can bind to and/or has affinity for a second antigenic determinant, part, domain or epitope on IL-6R different from the first antigenic determinant, part, domain or epitope on IL-6R;

and c) isolating the nucleic acid sequences that encode an amino acid sequence that can bind to and/or has affinity for a second antigenic determinant, part, domain or epitope on IL-6R different from the first antigenic determinant, part, domain or epitope on IL-6R, obtained in b), optionally followed by expressing the encoded amino acid sequence.

In this preferred method, the first amino acid sequence in the fusion protein encoded by said set collection or library of nucleic acid sequences may be the same amino acid sequence for all members of the set, collection or library of nucleic acid sequences encoding the fusion protein; or the first amino acid sequence in the fusion protein encoded by said set collection or library of nucleic acid sequences may also be a member of a set collection or library of different amino acid sequences.

Again, in such a method, the set, collection or library of nucleic acid sequences encoding amino acid sequences that form part of the fusion protein may for example be a set, collection or library of nucleic acid sequences encoding a naïve set, collection or library of immunoglobulin sequences; a set, collection or library of nucleic acid sequences encoding a synthetic or semi-synthetic set, collection or library of immunoglobulin sequences; and/or a set, collection or library of nucleic acid sequences encoding a set, collection or library of immunoglobulin sequences that have been subjected to affinity maturation.

Also, in such a method, the set, collection or library of nucleic acid sequences may encode a set, collection or library of heavy chain variable domains (such as $V_H$ domains or $V_{HH}$ domains) or of light chain variable domains. For example, the set, collection or library of nucleic acid sequences may encode a set, collection or library of domain antibodies or single domain antibodies, or a set, collection or library of amino acid sequences that are capable of functioning as a domain antibody or single domain antibody.

In a preferred aspect of this method, the set, collection or library of nucleic acid sequences may be an immune set, collection or library of nucleic acid sequences, for example derived from a mammal that has been suitably immunized with IL-6R or with a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

The set, collection or library of nucleic acid sequences may for example encode an immune set, collection or library of heavy chain variable domains or of light chain variable domains. In one specific aspect, the set, collection or library of nucleotide sequences may encode a set, collection or library of $V_{HH}$ sequences.

In the above methods, the set, collection or library of nucleotide sequences may be displayed on a phage, phagemid, ribosome or suitable micro-organism (such as yeast), such as to facilitate screening. Suitable methods, techniques and host organisms for displaying and screening (a set, collection or library of) nucleotide sequences encoding amino acid sequences will be clear to the person skilled in the art, for example on the basis of the further disclosure herein. Reference is also made to the review by Hoogenboom in Nature Biotechnology, 23, 9, 1105-1116 (2005).

In step b), the set, collection or library of nucleic acid sequences may also be screened for nucleic acid sequences that encode an amino acid sequence that can bind to and/or has affinity for both the first antigenic determinant, part, domain or epitope on IL-6R and the second antigenic determinant, part, domain or epitope on IL-6R. This may for example be performed in subsequent steps (i.e. by in a first step screening or selecting for nucleic acid sequences that encode an amino acid sequence that can bind to and/or has affinity for the second antigenic determinant, part, domain or epitope on IL-6R, and subsequently in a second step selecting or screening for nucleic acid sequences that encode an amino acid sequence that can bind to and/or has affinity for the first antigenic determinant, part, domain or epitope on IL-6R; or visa versa) or in a single step (i.e. by simultaneously screening or selecting for nucleic acid sequences that encode an amino acid sequence that can bind to and/or has affinity for both the first antigenic determinant, part, domain or epitope on IL-6R and the second antigenic determinant, part, domain or epitope on IL-6R).

In a preferred aspect of the above method, the first amino acid sequence used in step a) is preferably such that (i) it can bind to and/or has affinity for the IL-6 binding site on IL-6R (and may in particular be directed against one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or (ii) it competes with IL-6 for binding to IL-6R; and in step b), the set, collection or library of nucleic acid sequences is screened for nucleic acid sequences that encode (i) an amino acid sequence that can bind to and/or has affinity for another antigenic determinant, part, domain or epitope on IL-6R different from the first antigenic determinant, part, domain or epitope on IL-6R.

Alternatively, the first amino acid sequence used in step a) is preferably such that (i) it can bind to and/or has affinity for any antigenic determinant, part, domain or epitope on IL-6R; and in step b), the set, collection or library of nucleic acid sequences is screened for nucleic acid sequences that encode (i) an amino acid sequence that can bind to and/or has affinity for the IL-6 binding site on IL-6R (and may in particular be directed against one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or (ii) an amino acid sequence that can compete with IL-6 for binding to IL-6R.

In another preferred aspect of the above method, the first amino acid sequence used in step a) is preferably such that (i) it can bind to and/or has affinity for the gp130 binding site on IL-6R and/or the IL-6/IL-6R complex and/or (ii) it competes with gp130 for binding to the IL-6/IL-6R complex; and in step b), the set, collection or library of nucleic acid sequences is screened for nucleic acid sequences that encode (i) an amino acid sequence that can bind to and/or has affinity for another antigenic determinant, part, domain or epitope on IL-6R different from the first antigenic determinant, part, domain or epitope on IL-6R.

Alternatively, the first amino acid sequence used in step a) is preferably such that (i) it can bind to and/or has affinity for any antigenic determinant, part, domain or epitope on IL-6R; and in step b), the set, collection or library of nucleic acid sequences is screened for nucleic acid sequences that encode (i) an amino acid sequence that can bind to and/or has affinity for the gp130 binding site on IL-6R and/or the IL-6/IL-6R and/or (ii) an amino acid sequence that can compete with gp130 for binding to the IL-6/IL-6R complex.

In another preferred aspect of the above method, the first amino acid sequence used in step a) is preferably such that (i) it can bind to and/or has affinity for the Tocilizumab (MRA) binding site on IL-6R (and may in particular be directed against one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or (ii) it competes with Tocilizumab (MRA) for binding to IL-6R; and in step b), the set, collection or library of nucleic acid sequences is screened for nucleic acid sequences that encode (i) an amino acid sequence that can bind to and/or has affinity for another antigenic determinant, part, domain or epitope on IL-6R different from the first antigenic determinant, part, domain or epitope on IL-6R.

Alternatively, the first amino acid sequence used in step a) is preferably such that (i) it can bind to and/or has affinity for any antigenic determinant, part, domain or epitope on IL-6R; and in step b), the set, collection or library of nucleic acid sequences is screened for nucleic acid sequences that encode (i) an amino acid sequence that can bind to and/or has affinity for the Tocilizumab (MRA) binding site on IL-6R (and may in particular be directed against one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or (ii) an amino acid sequence that can compete with Tocilizumab (MRA) for binding to IL-6R.

In another preferred aspect of the above method, the first amino acid sequence used in step a) is preferably such that (i) it can bind to and/or has affinity for the M182 binding site on IL-6R and/or (ii) it competes with M182 for binding to IL-6R; and in step b), the set, collection or library of nucleic acid sequences is screened for nucleic acid sequences that encode (i) an amino acid sequence that can bind to and/or has affinity for another antigenic determinant, part, domain or epitope on IL-6R different from the first antigenic determinant, part, domain or epitope on IL-6R.

Alternatively, the first amino acid sequence used in step a) is preferably such that (i) it can bind to and/or has affinity for any antigenic determinant, part, domain or epitope on IL-6R; and in step b), the set, collection or library of nucleic acid sequences is screened for nucleic acid sequences that encode (i) an amino acid sequence that can bind to and/or has affinity for the M182 binding site on IL-6R and/or (ii) an amino acid sequence that can compete with M182 for binding to IL-6R.

In another preferred aspect of the above method, the first amino acid sequence used in step a) is preferably such that (i) it can bind to and/or has affinity for the BN-12 binding site on IL-6R and/or (ii) it competes with BN-12 for binding to IL-6R; and in step b), the set, collection or library of nucleic acid sequences is screened for nucleic acid sequences that encode (i) an amino acid sequence that can bind to and/or has affinity for another antigenic determinant, part, domain or epitope on IL-6R different from the first antigenic determinant, part, domain or epitope on IL-6R.

Alternatively, the first amino acid sequence used in step a) is preferably such that (i) it can bind to and/or has affinity for any antigenic determinant, part, domain or epitope on IL-6R; and in step b), the set, collection or library of nucleic acid sequences is screened for nucleic acid sequences that encode (i) an amino acid sequence that can bind to and/or has affinity for the BN-12 binding site on IL-6R and/or (ii) an amino acid sequence that can compete with BN-12 for binding to IL-6R.

In another preferred aspect of the above method, the first amino acid sequence used in step a) is preferably such that (i) it can bind to and/or has affinity for the IL-6 binding site on IL-6R (and may in particular be directed against one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or (ii) competes with IL-6 for binding to IL-6R; and in step b), the set, collection or library of nucleic acid sequences is screened for nucleic acid sequences that encode (i) an amino acid sequence that can bind to and/or has affinity for the gp130 binding site on IL-6R and/or the IL-6/IL-6R complex and/or (ii) an amino acid sequence that can compete with gp130 for binding to the IL-6/IL-6R complex.

Alternatively, the first amino acid sequence used in step a) is preferably such that (i) it can bind to and/or has affinity for the gp130 binding site on IL-6R and/or the IL-6/IL-6R complex and/or (ii) competes with gp130 for binding to the IL-6/IL-6R complex; and in step b), the set, collection or library of nucleic acid sequences is screened for nucleic acid sequences that encode (i) an amino acid sequence that can bind to and/or has affinity for the IL-6 binding site on IL-6R (and may in particular be directed against one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or (ii) an amino acid sequence that can compete with IL-6 for binding to IL-6R.

In another preferred aspect of the above method, the first amino acid sequence used in step a) is preferably such that (1) it can bind to and/or has affinity for the IL-6 binding site on IL-6R (and may in particular be directed against one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or (ii) competes with IL-6 for binding to IL-6R; and in step b), the set, collection or library of nucleic acid sequences is screened for nucleic acid sequences that encode (i) an amino acid sequence that can bind to and/or has affinity for the M182 binding site on IL-6R and/or (ii) an amino acid sequence that can compete with M182 for binding to IL-6R.

Alternatively, the first amino acid sequence used in step a) is preferably such that (1) it can bind to and/or has affinity for the M182 binding site on IL-6R and/or (ii) competes with M182 for binding to IL-6R; and in step b), the set, collection or library of nucleic acid sequences is screened for nucleic acid sequences that encode (1) an amino acid sequence that can bind to and/or has affinity for the IL-6 binding site on IL-6R (and may in particular be directed against one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or (ii) an amino acid sequence that can compete with IL-6 for binding to IL-6R.

In another preferred aspect of the above method, the first amino acid sequence used in step a) is preferably such that (i) it can bind to and/or has affinity for the IL-6 binding site on IL-6R (and may in particular be directed against one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or (ii) competes with IL-6 for binding to IL-6R; and in step b), the set, collection or library of nucleic acid sequences is screened for nucleic acid sequences that encode (i) an amino acid sequence that can bind to and/or has affinity for the BN-12 binding site on IL-6R and/or (ii) an amino acid sequence that can compete with BN-12 for binding to IL-6R.

Alternatively, the first amino acid sequence used in step a) is preferably such that (i) it can bind to and/or has affinity for the BN-12 binding site on IL-6R and/or (ii) competes with BN-12 for binding to IL-6R; and in step b), the set, collection or library of nucleic acid sequences is screened for nucleic acid sequences that encode (i) an amino acid sequence that can bind to and/or has affinity for the IL-6 binding site on IL-6R (and may in particular be directed against one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or (ii) an amino acid sequence that can compete with IL-6 for binding to IL-6R.

In a preferred aspect of the above method, the first amino acid sequence used in step a) is preferably such that (i) it can bind to and/or has affinity for the Tocilizumab (MRA) binding site on IL-6R (and may in particular be directed against one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or (ii) competes with Tocilizumab (MRA) for binding to IL-6R; and in step b), the set, collection or library of nucleic acid sequences is screened for nucleic acid sequences that encode (i) an amino acid sequence that can bind to and/or has affinity for the gp130 binding site on IL-6R and/or the IL-6/IL-6R complex and/or (ii) an amino acid sequence that can compete with gp130 for binding to the IL-6/IL-6R complex.

Alternatively, the first amino acid sequence used in step a) is preferably such that (i) it can bind to and/or has affinity for the gp130 binding site on IL-6R and/or the IL-6/IL-6R complex and/or (ii) competes with gp130 for binding to the IL-6/IL-6R complex; and in step b), the set, collection or library of nucleic acid sequences is screened for nucleic acid sequences that encode (i) an amino acid sequence that can bind to and/or has affinity for the Tocilizumab (MRA) binding site on IL-6R (and may in particular be directed against one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or (ii) an amino acid sequence that can compete with Tocilizumab (MRA) for binding to IL-6R.

In a preferred aspect of the above method, the first amino acid sequence used in step a) is preferably such that (i) it can bind to and/or has affinity for the Tocilizumab (MRA) binding site on IL-6R (and may in particular be directed against one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or (ii) competes with Tocilizumab (MRA) for binding to IL-6R; and in step b), the set, collection or library of nucleic acid sequences is screened for nucleic acid sequences that encode (i) an amino acid sequence that can bind to and/or has affinity for the M182 binding site on IL-6R and/or (ii) an amino acid sequence that can compete with M182 for binding to IL-6R.

Alternatively, the first amino acid sequence used in step a) is preferably such that (i) it can bind to and/or has affinity for the M182 binding site on IL-6R and/or (ii) competes with M182 for binding to IL-6R; and in step b), the set, collection or library of nucleic acid sequences is screened for nucleic acid sequences that encode (i) an amino acid sequence that can bind to and/or has affinity for the Tocilizumab (MRA) binding site on IL-6R (and may in particular be directed against one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or (ii) an amino acid sequence that can compete with Tocilizumab (MRA) for binding to IL-6R.

In a preferred aspect of the above method, the first amino acid sequence used in step a) is preferably such that (i) it can bind to and/or has affinity for the Tocilizumab (MRA) binding site on IL-6R (and may in particular be directed against one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or (ii) competes with Tocilizumab (MRA) for binding to IL-6R; and in step b), the set, collection or library of nucleic acid sequences is screened for nucleic acid sequences that encode (i) an amino acid sequence that can bind to and/or has affinity for the BN-12 binding site on IL-6R and/or (ii) an amino acid sequence that can compete with BN-12 for binding to IL-6R.

Alternatively, the first amino acid sequence used in step a) is preferably such that (i) it can bind to and/or has affinity for the BN-12 binding site on IL-6R and/or (ii) competes with BN-12 for binding to IL-6R; and in step b), the set, collection or library of nucleic acid sequences is screened for nucleic acid sequences that encode (i) an amino acid sequence that can bind to and/or has affinity for the Tocilizumab (MRA) binding site on IL-6R (and may in particular be directed against one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or (ii) an amino acid sequence that can compete with Tocilizumab (MRA) for binding to IL-6R.

In a preferred aspect of the above method, the first amino acid sequence used in step a) is preferably such that (i) it can bind to and/or has affinity for the BN-12 binding site on IL-6R and/or (ii) competes with BN-12 for binding to IL-6R; and in step b), the set, collection or library of nucleic acid sequences is screened for nucleic acid sequences that encode (i) an amino acid sequence that can bind to and/or has affinity for the gp130 binding site on IL-6R and/or the IL-6/IL-6R complex and/or (ii) an amino acid sequence that can compete with gp130 for binding to the IL-6/IL-6R complex.

Alternatively, the first amino acid sequence used in step a) is preferably such that (i) it can bind to and/or has affinity for the gp130 binding site on IL-6R and/or the IL-6/IL-6R complex and/or (ii) competes with gp130 for binding to the IL-6/IL-6R complex; and in step b), the set, collection or library of nucleic acid sequences is screened for nucleic acid sequences that encode (i) an amino acid sequence that can bind to and/or has affinity for the BN-12 binding site on IL-6R and/or (ii) an amino acid sequence that can compete with BN-12 for binding to IL-6R.

In a preferred aspect of the above method, the first amino acid sequence used in step a) is preferably such that (i) it can bind to and/or has affinity for the BN-12 binding site on IL-6R and/or (ii) competes with BN-12 for binding to IL-6R; and in step b), the set, collection or library of nucleic acid sequences is screened for nucleic acid sequences that encode (i) an amino acid sequence that can bind to and/or has affinity for the M182 binding site on IL-6R and/or (ii) an amino acid sequence that can compete with M182 for binding to IL-6R.

Alternatively, the first amino acid sequence used in step a) is preferably such that (i) it can bind to and/or has affinity for the M182 binding site on IL-6R and/or (ii) competes with M182 for binding to IL-6R; and in step b), the set, collection or library of nucleic acid sequences is screened for nucleic acid sequences that encode (i) an amino acid sequence that can bind to and/or has affinity for the BN-12 binding site on IL-6R and/or (ii) an amino acid sequence that can compete with BN-12 for binding to IL-6R.

In the above methods, screening or selecting for (nucleic acid sequences that encode) amino acid sequences that compete with IL-6. gp130, Tocilizumab (MRA), BN-12 or M182, respectively, may be performed using generally known methods for screening or selecting for competitors of known binding molecules, which may for example involve performing the screening or selection in the presence of the binding molecule and/or determining the binding affinity of the compound(s) to be screened in the presence of the binding molecule.

It is also possible, in step b), to screen for nucleic acid sequences that both (i) encode an amino acid sequence that can bind to and/or has affinity for the IL-6 binding site on IL-6R (and in particular one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or that can compete with IL-6 for binding to IL-6R; and that also (ii) encode an amino acid sequence that can bind to and/or has affinity for the gp130 binding site on IL-6R and/or the IL-6/IL-6R complex and/or that can compete with gp130 for binding to the IL-6/IL-6R complex. Again, this may be performed in separate steps or a single step, and by selecting or screening in the presence of IL-6 and/or gp130, as applicable.

It is also possible, in step b), to screen for nucleic acid sequences that both (i) encode an amino acid sequence that can bind to and/or has affinity for the IL-6 binding site on IL-6R (and in particular one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or that can compete with IL-6 for binding to IL-6R; and that also (ii) encode an amino acid sequence that can bind to and/or has affinity for the M182 binding site on IL-6R and/or that can compete with M182 for binding to IL-6R. Again, this may be performed in separate steps or a single step, and by selecting or screening in the presence of IL-6 and/or M182, as applicable.

It is also possible, in step b), to screen for nucleic acid sequences that both (i) encode an amino acid sequence that can bind to and/or has affinity for the IL-6 binding site on IL-6R (and in particular one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or that can compete with IL-6 for binding to IL-6R; and that also (ii) encode an amino acid sequence that can bind to and/or has affinity for the BN-12 binding site on IL-6R and/or that can compete with BN-12 for binding to IL-6R. Again, this may be performed in separate steps or a single step, and by selecting or screening in the presence of IL-6 and/or BN-12, as applicable.

It is also possible, in step b), to screen for nucleic acid sequences that both (i) encode an amino acid sequence that can bind to and/or has affinity for the Tocilizumab (MRA) binding site on IL-6R (and in particular one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or that can compete with Tocilizumab (MRA) for binding to IL-6R; and that also (ii) encode an amino acid sequence that can bind to and/or has affinity for the gp130 binding site on IL-6R and/or the IL-6/IL-6R complex and/or that can compete with gp130 for binding to the IL-6/IL-6R complex. Again, this may be performed in separate steps or a single step, and by selecting or screening in the presence of Tocilizumab (MRA) and/or gp130, as applicable.

It is also possible, in step b), to screen for nucleic acid sequences that both (i) encode an amino acid sequence that can bind to and/or has affinity for the Tocilizumab (MRA) binding site on IL-6R (and in particular one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or that can compete with Tocilizumab (MRA) for binding to IL-6R; and that also (ii) encode an amino acid sequence that can bind to and/or has affinity for the M182 binding site on IL-6R and/or that can compete with M182 for binding to IL-6R. Again, this may be performed in separate steps or a single step, and by selecting or screening in the presence of Tocilizumab (MRA) and/or M182, as applicable.

It is also possible, in step b), to screen for nucleic acid sequences that both (i) encode an amino acid sequence that can bind to and/or has affinity for the Tocilizumab (MRA) binding site on IL-6R (and in particular one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or that can compete with Tocilizumab (MRA) for binding to IL-6R; and that also (ii) encode an amino acid sequence that can bind to and/or has affinity for the BN-12 binding site on IL-6R and/or that can compete with BN-12 for binding to IL-6R. Again, this may be performed in separate steps or a single step, and by selecting or screening in the presence of Tocilizumab (MRA) and/or BN-12, as applicable.

It is also possible, in step b), to screen for nucleic acid sequences that both (i) encode an amino acid sequence that can bind to and/or has affinity for the BN-12 binding site on IL-6R and/or that can compete with BN-12 for binding to IL-6R; and that also (ii) encode an amino acid sequence that can bind to and/or has affinity for the gp130 binding site on IL-6R and/or the IL-6/IL-6R complex and/or that can compete with gp130 for binding to the IL-6/IL-6R complex. Again, this may be performed in separate steps or a single step, and by selecting or screening in the presence of BN-12 and/or gp130, as applicable.

It is also possible, in step b), to screen for nucleic acid sequences that both (i) encode an amino acid sequence that can bind to and/or has affinity for the BN-12 binding site on IL-6R and/or that can compete with BN-12 for binding to IL-6R; and that also (ii) encode an amino acid sequence that can bind to and/or has affinity for the M182 binding site on IL-6R and/or that can compete with M182 for binding to IL-6R. Again, this may be performed in separate steps or a single step, and by selecting or screening in the presence of BN-12 and/or M182, as applicable.

It will also be clear to the skilled person that the above methods may be performed by screening a set, collection or library of amino acid sequences that correspond to (e.g. are encoded by) the nucleic acid sequences used in the above method; and such methods form further aspects of the invention.

The invention in a further aspect provides a method for preparing and generating biparatopic polypeptides of the invention which comprises at least the steps of:

a) providing a set, collection or library of nucleic acid sequences, in which each nucleic acid sequence in said set, collection or library encodes a fusion protein that comprises a first amino acid sequence that can bind to and/or has affinity for a first antigenic determinant, part, domain or epitope on IL-6R that is fused via a linker sequence to a second amino acid sequence that can bind to and/or has affinity for a second antigenic determinant, part, domain or epitope on IL-6R (which may be the same or different as the first antigenic determinant, part, domain or epitope on IL-6R), in which essentially each nucleic acid sequence (or most of these) encodes a fusion protein with a different linker sequence so as to provide a set, collection or library of nucleic acid sequences encoding different fusion proteins;

b) screening said set, collection or library of nucleic acid sequences for nucleic acid sequences that encode an amino acid sequence that can bind to and/or has affinity for the first and second antigenic determinant, part, domain or epitope on IL-6R; and c) isolating the nucleic acid sequences that encode an amino acid sequence that can bind to and/or has affinity for the first and second antigenic determinant, part, domain or epitope on IL-6R, optionally followed by expressing the encoded amino acid sequence.

As will be clear to the skilled person, this method can be used to screen for suitable or even optimal linker lengths for linking the first and second amino acid sequence. For example, in this aspect, the first amino acid sequence may be an amino acid sequence that can bind to and/or has affinity for the IL-6 binding site on IL-6R (and in particular one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or that can compete with IL-6 for binding to IL-6R; and the second amino acid sequence may be an amino acid sequence that can bind to and/or has affinity for another antigenic determinant, part, domain or epitope on IL-6R (or visa versa). The first amino acid sequence may be an amino acid sequence that can bind to and/or has affinity for the gp130 binding site on IL-6R and/or the IL-6/IL-6R complex and/or that can compete with gp130 for binding to the IL-6/IL-6R complex; and the second amino acid sequence may be an amino acid sequence that can bind to and/or has affinity for another antigenic determinant, part, domain or epitope on IL-6R (or visa versa). The first amino acid sequence may be an amino acid sequence that can bind to and/or has affinity for the Tocilizumab (MRA) binding site on IL-6R (and in particular one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or that can compete with Tocilizumab (MRA) for binding to IL-6R; and the second amino acid sequence may be an amino acid sequence that can bind to and/or has affinity for another antigenic determinant, part, domain or epitope on IL-6R (or visa versa). The first amino acid sequence may be an amino acid sequence that can bind to and/or has affinity for the M182 binding site on IL-6R and/or that can compete with M182 for binding to IL-6R; and the second amino acid sequence may be an amino acid sequence that can bind to and/or has affinity for another antigenic determinant, part, domain or epitope on IL-6R (or visa versa). The first amino acid sequence may be an amino acid sequence that can bind to and/or has affinity for the BN-12 binding site on IL-6R and/or that can compete with Bn-12 for binding to IL-6R; and the second amino acid sequence may be an amino acid sequence that can bind to and/or has affinity for another antigenic determinant, part, domain or epitope on IL-6R (or visa versa). The screening and selection step b) may be performed as further described above.

For example, in this aspect, the first amino acid sequence may be an amino acid sequence that can bind to and/or has affinity for the IL-6 binding site on IL-6R (and in particular one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or that can compete with IL-6 for binding to IL-6R; and the second amino acid sequence may be an amino acid sequence that can bind to and/or has affinity for the gp130 binding site on IL-6R and/or the IL-6/IL-6R complex and/or that can compete with gp130 for binding to the IL-6/IL-6R complex (or visa versa). The screening and selection step b) may be performed as further described above.

In this aspect, the first amino acid sequence may be an amino acid sequence that can bind to and/or has affinity for the IL-6 binding site on IL-6R (and in particular one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or that can compete with IL-6 for binding to IL-6R; and the second amino acid sequence may be an amino acid sequence that can bind to and/or has affinity for the M182 binding site on IL-6R and/or that can compete with M182 for binding to the IL-6/IL-6R complex (or visa versa). The screening and selection step b) may be performed as further described above.

In this aspect, the first amino acid sequence may be an amino acid sequence that can bind to and/or has affinity for the IL-6 binding site on IL-6R (and in particular one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or that can compete with IL-6 for binding to IL-6R; and the second amino acid sequence may be an amino acid sequence that can bind to and/or has affinity for the BN-12 binding site on IL-6R and/or that can compete with BN-12 for binding to the IL-6/IL-6R complex (or visa versa). The screening and selection step b) may be performed as further described above.

In this aspect, the first amino acid sequence may be an amino acid sequence that can bind to and/or has affinity for the Tocilizumab (MRA) binding site on IL-6R (and in particular one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or that can compete with Tocilizumab (MRA) for binding to IL-6R; and the second amino acid sequence may be an amino acid sequence that can bind to and/or has affinity for the gp130 binding site on IL-6R and/or the IL-6/IL-6R complex and/or that can compete with gp130 for binding to the IL-6/IL-6R complex (or visa versa). The screening and selection step b) may be performed as further described above.

In this aspect, the first amino acid sequence may be an amino acid sequence that can bind to and/or has affinity for the Tocilizumab (MRA) binding site on IL-6R (and in particular one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or that can compete with Tocilizumab (MRA) for binding to IL-6R; and the second amino acid sequence may be an amino acid sequence that can bind to and/or has affinity for the M182 binding site on IL-6R and/or that can compete with M182 for binding to the IL-6/IL-6R complex (or visa versa). The screening and selection step b) may be performed as further described above.

In this aspect, the first amino acid sequence may be an amino acid sequence that can bind to and/or has affinity for the Tocilizumab (MRA) binding site on IL-6R (and in particular one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or that can compete with Tocilizumab (MRA) for binding to IL-6R; and the second amino acid sequence may be an amino acid sequence that can bind to and/or has affinity for the BN-12 binding site on IL-6R and/or that can compete with BN-12 for binding to the IL-6/IL-6R complex (or visa versa). The screening and selection step b) may be performed as further described above.

In this aspect, the first amino acid sequence may be an amino acid sequence that can bind to and/or has affinity for the BN-12 binding site on IL-6R and/or that can compete with BN-12 for binding to IL-6R; and the second amino acid sequence may be an amino acid sequence that can bind to and/or has affinity for the gp130 binding site on IL-6R and/or the IL-6/IL-6R complex and/or that can compete with gp130 for binding to the IL-6/IL-6R complex (or visa versa). The screening and selection step b) may be performed as further described above.

In this aspect, the first amino acid sequence may be an amino acid sequence that can bind to and/or has affinity for the BN-12 binding site on IL-6R and/or that can compete with BN-12 for binding to IL-6R; and the second amino acid sequence may be an amino acid sequence that can bind to and/or has affinity for the M182 binding site on IL-6R and/or that can compete with M182 for binding to the IL-6/IL-6R complex (or visa versa). The screening and selection step b) may be performed as further described above.

Another method for preparing and generating biparatopic polypeptides of the invention may comprise at least the steps of:
a) providing a set, collection or library of nucleic acid sequences encoding amino acid sequences;
b) screening said set, collection or library of nucleic acid sequences for a set, collection or library of nucleic acid sequences that encode an amino acid sequence that can bind to and/or has affinity for IL-6R;
c) ligating said set, collection or library of nucleic acid sequences that encode an amino acid sequence that can bind to and/or has affinity for IL-6R to another nucleic acid sequence that encodes an amino acid sequence that can bind to and/or has affinity for IL-6R (e.g. a nucleic acid sequence that encodes an amino acid sequence that competes with IL-6 for binding IL-6R);
and
d) from the set, collection or library of nucleic acid sequences obtained in c), isolating the nucleic acid sequences encoding a biparatopic amino acid sequence that can bind to and/or has affinity for IL-6R (and e.g. further selecting for nucleic acid sequences that encode a biparatopic amino acid sequence that antagonizes with higher potency compared to the monovalent amino acid sequences), followed by expressing the encoded amino acid sequence.

The nucleic acid sequence encoding the biparatopic polypeptide obtained in the method above can subsequently be fused to one or more further sets, collections or libraries of nucleic acid sequences encoding amino acid sequences that can bind to and/or have affinity for IL-6R in order to obtain a triparatopic or multiparatopic amino acid sequence respectively.

In such a method, the set, collection or library of nucleic acid sequences encoding amino acid sequences may for example be a set, collection or library of nucleic acid sequences encoding a naïve set, collection or library of immunoglobulin sequences; a set, collection or library of nucleic acid sequences encoding a synthetic or semi-synthetic set, collection or library of immunoglobulin sequences; and/or a set, collection or library of nucleic acid sequences encoding a set, collection or library of immunoglobulin sequences that have been subjected to affinity maturation.

The set, collection or library of nucleic acid sequences that encode an amino acid sequence that can bind to and/or has affinity for IL-6R can be obtained by any selection or screening method known in the art for the selection and/or screening of nucleic acid sequences that encode an amino acid sequence that can bind to and/or has affinity for IL-6R and as, for example, described in the Examples section.

Also, in such a method, the set, collection or library of nucleic acid sequences may encode a set, collection or library of heavy chain variable domains (such as $V_H$ domains or $V_{HH}$ domains) or of light chain variable domains. For example, the set, collection or library of nucleic acid sequences may encode a set, collection or library of domain antibodies or single domain antibodies, or a set, collection or library of amino acid sequences that are capable of functioning as a domain antibody or single domain antibody.

In a preferred aspect of this method, the set, collection or library of nucleic acid sequences may be an immune set, collection or library of nucleic acid sequences, for example derived from a mammal that has been suitably immunized with IL-6R or with a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

The set, collection or library of nucleic acid sequences may for example encode an immune set, collection or library of heavy chain variable domains or of light chain variable domains. In one specific aspect, the set, collection or library of nucleotide sequences may encode a set, collection or library of $V_{HH}$ sequences.

In the above methods, the nucleic acid sequence may be displayed on a phage, phagemid, ribosome or suitable micro-organism (such as yeast), such as to facilitate screening. Suitable methods, techniques and host organisms for displaying and screening (a set, collection or library of) nucleotide sequences encoding amino acid sequences will be clear to the person skilled in the art, for example on the basis of the further disclosure herein. Reference is also made to the review by Hoogenboom in Nature Biotechnology, 23, 9, 1105-1116 (2005).

Another method for preparing and generating biparatopic polypeptides of the invention may comprise at least the steps of:
a) providing a first set, collection or library of nucleic acid sequences encoding amino acid sequences;
b) screening said first set, collection or library of nucleic acid sequences for a nucleic acid sequence that encodes an amino acid sequence that can bind to and/or has affinity for a first antigenic determinant, part, domain or epitope on IL-6R;

c) ligating the nucleic acid sequence encoding said amino acid sequence that can bind to and/or has affinity for a first antigenic determinant, part, domain or epitope on IL-6R obtained in b) to another set, collection or library of nucleic acid sequences encoding amino acid sequences to obtain a set, collection or library of nucleic acid sequences that encode fusion proteins;

d) screening said set, collection or library of nucleic acid sequences obtained in step c) for a nucleic acid sequence that encodes an amino acid sequence that can bind a second antigenic determinant, part, domain or epitope on IL-6R different from the first antigenic determinant, part, domain or epitope on IL-6R; and e) isolating the nucleic acid sequence that encodes an amino acid sequence that can bind to and/or has affinity for the first and second antigenic determinant, part, domain or epitope on IL-6R, optionally followed by expressing the encoded amino acid sequence.

In a preferred aspect of the above method, the first amino acid sequence obtained in step b) is preferably such that (i) it can bind to and/or has affinity for the IL-6 binding site on IL-6R (and in particular one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or (ii) competes with IL-6 for binding to IL-6R; and in step d), the set, collection or library of nucleic acid sequences is screened for nucleic acid sequences that encode an amino acid sequence that can bind to and/or has affinity for a second antigenic determinant, part, domain or epitope on IL-6R different from the first antigenic determinant, part, domain or epitope on IL-6R.

Alternatively, the first amino acid sequence obtained in step b) is preferably such that it can bind to and/or has affinity for a first antigenic determinant, part, domain or epitope on IL-6R; and in step d), the set, collection or library of nucleic acid sequences is screened for nucleic acid sequences that encode (i) an amino acid sequence that can bind to and/or has affinity for the IL-6 binding site on IL-6R (and in particular one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or (ii) an amino acid sequence that can compete with IL-6 for binding to IL-6R.

In another preferred aspect of the above method, the first amino acid sequence obtained in step b) is preferably such that (i) it can bind to and/or has affinity for the gp130 binding site on IL-6R and/or the IL-6/IL-6R complex; and in step d), the set, collection or library of nucleic acid sequences is screened for nucleic acid sequences that encode an amino acid sequence that can bind to and/or has affinity for a second antigenic determinant, part, domain or epitope on IL-6R different from the first antigenic determinant, part, domain or epitope on IL-6R.

Alternatively, the first amino acid sequence obtained in step b) is preferably such that it can bind to and/or has affinity for a first antigenic determinant, part, domain or epitope on IL-6R; and in step d), the set, collection or library of nucleic acid sequences is screened for nucleic acid sequences that encode (i) an amino acid sequence that can bind to and/or has affinity for the gp130 binding site on IL-6R and/or the IL-6/IL-6R complex and/or (ii) an amino acid sequence that can compete with gp130 for binding to the IL-6/IL-6R complex.

In a preferred aspect of the above method, the first amino acid sequence obtained in step b) is preferably such that (i) it can bind to and/or has affinity for the Tocilizumab (MRA) binding site on IL-6R (and in particular one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or (ii) competes with Tocilizumab (MRA) for binding to IL-6R; and in step d), the set, collection or library of nucleic acid sequences is screened for nucleic acid sequences that encode an amino acid sequence that can bind to and/or has affinity for a second antigenic determinant, part, domain or epitope on IL-6R different from the first antigenic determinant, part, domain or epitope on IL-6R.

Alternatively, the first amino acid sequence obtained in step b) is preferably such that it can bind to and/or has affinity for a first antigenic determinant, part, domain or epitope on IL-6R; and in step d), the set, collection or library of nucleic acid sequences is screened for nucleic acid sequences that encode (i) an amino acid sequence that can bind to and/or has affinity for the Tocilizumab (MRA) binding site on IL-6R (and in particular one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or (ii) an amino acid sequence that can compete with Tocilizumab (MRA) for binding to IL-6R.

In a preferred aspect of the above method, the first amino acid sequence obtained in step b) is preferably such that (i) it can bind to and/or has affinity for the M182 binding site on IL-6R (and in particular one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or (ii) competes with M182 for binding to IL-6R; and in step d), the set, collection or library of nucleic acid sequences is screened for nucleic acid sequences that encode an amino acid sequence that can bind to and/or has affinity for a second antigenic determinant, part, domain or epitope on IL-6R different from the first antigenic determinant, part, domain or epitope on IL-6R.

In a preferred aspect of the above method, the first amino acid sequence obtained in step b) is preferably such that (i) it can bind to and/or has affinity for the BN-12 binding site on IL-6R and/or (ii) competes with BN-12 for binding to IL-6R; and in step d), the set, collection or library of nucleic acid sequences is screened for nucleic acid sequences that encode an amino acid sequence that can bind to and/or has affinity for a second antigenic determinant, part, domain or epitope on IL-6R different from the first antigenic determinant, part, domain or epitope on IL-6R.

Alternatively, the first amino acid sequence obtained in step b) is preferably such that it can bind to and/or has affinity for a first antigenic determinant, part, domain or epitope on IL-6R; and in step d), the set, collection or library of nucleic acid sequences is screened for nucleic acid sequences that encode (i) an amino acid sequence that can bind to and/or has affinity for the BN-12 binding site on IL-6R and/or (ii) an amino acid sequence that can compete with BN-12 for binding to IL-6R.

In another preferred aspect of the above method, the first amino acid sequence obtained in step b) is preferably such that (i) it can bind to and/or has affinity for the IL-6 binding site on IL-6R (and in particular one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or (ii) competes with IL-6 for binding to IL-6R; and in step d), the set, collection or library of nucleic acid sequences is screened for nucleic acid sequences that encode (i) an amino acid sequence that can bind to and/or has affinity for the gp130 binding site on IL-6R or the IL-6/IL-6R complex and/or (ii) an amino acid sequence that can compete with gp130 for binding to the IL-6/IL-6R complex.

Alternatively, the first amino acid sequence obtained in step b) is preferably such that (i) it can bind to and/or has affinity for the gp130 binding site on IL-6R and/or the IL-6/IL-6R complex and/or (ii) competes with gp130 for binding to the IL-6/IL-6R complex; and in step d), the set, collection or library of nucleic acid sequences is screened for nucleic acid sequences that encode (i) an amino acid sequence that can bind to and/or has affinity for the IL-6 binding site on IL-6R (and in particular one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or (ii) an amino acid sequence that can compete with IL-6 for binding to IL-6R.

In another preferred aspect of the above method, the first amino acid sequence obtained in step b) is preferably such that (i) it can bind to and/or has affinity for the IL-6 binding site on IL-6R (and in particular one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or (ii) competes with IL-6 for binding to IL-6R; and in step d), the set, collection or library of nucleic acid sequences is screened for nucleic acid sequences that encode (i) an amino acid sequence that can bind to and/or has affinity for the M182 binding site on IL-6R and/or (ii) an amino acid sequence that can compete with M182 for binding to the IL-6R.

Alternatively, the first amino acid sequence obtained in step b) is preferably such that (i) it can bind to and/or has affinity for the M182 binding site on IL-6R and/or (ii) competes with M182 for binding to the IL-6R; and in step d), the set, collection or library of nucleic acid sequences is screened for nucleic acid sequences that encode (i) an amino acid sequence that can bind to and/or has affinity for the IL-6 binding site on IL-6R (and in particular one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or (ii) an amino acid sequence that can compete with IL-6 for binding to IL-6R.

In another preferred aspect of the above method, the first amino acid sequence obtained in step b) is preferably such that (i) it can bind to and/or has affinity for the IL-6 binding site on IL-6R (and in particular one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or (ii) competes with IL-6 for binding to IL-6R; and in step d), the set, collection or library of nucleic acid sequences is screened for nucleic acid sequences that encode (1) an amino acid sequence that can bind to and/or has affinity for the BN-12 binding site on IL-6R and/or (ii) an amino acid sequence that can compete with BN-12 for binding to the IL-6R.

Alternatively, the first amino acid sequence obtained in step b) is preferably such that (i) it can bind to and/or has affinity for the Bn-12 binding site on IL-6R and/or (ii) competes with Bn-12 for binding to the IL-6R; and in step d), the set, collection or library of nucleic acid sequences is screened for nucleic acid sequences that encode (i) an amino acid sequence that can bind to and/or has affinity for the IL-6 binding site on IL-6R (and in particular one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or (ii) an amino acid sequence that can compete with IL-6 for binding to IL-6R.

In another preferred aspect of the above method, the first amino acid sequence obtained in step b) is preferably such that (i) it can bind to and/or has affinity for the Tocilizumab (MRA) binding site on IL-6R (and in particular one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or (ii) competes with Tocilizumab (MRA) for binding to IL-6R; and in step d), the set, collection or library of nucleic acid sequences is screened for nucleic acid sequences that encode (i) an amino acid sequence that can bind to and/or has affinity for the gp130 binding site on IL-6R or the IL-6/IL-6R complex and/or (ii) an amino acid sequence that can compete with gp130 for binding to the IL-6/IL-6R complex.

Alternatively, the first amino acid sequence obtained in step b) is preferably such that (i) it can bind to and/or has affinity for the gp130 binding site on IL-6R and/or the IL-6/IL-6R complex and/or (ii) competes with gp130 for binding to the IL-6/IL-6R complex; and in step d), the set, collection or library of nucleic acid sequences is screened for nucleic acid sequences that encode (i) an amino acid sequence that can bind to and/or has affinity for the Tocilizumab (MRA) binding site on IL-6R (and in particular one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or (ii) an amino acid sequence that can compete with Tocilizumab (MRA) for binding to IL-6R.

In another preferred aspect of the above method, the first amino acid sequence obtained in step b) is preferably such that (i) it can bind to and/or has affinity for the Tocilizumab (MRA) binding site on IL-6R (and in particular one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or (ii) competes with Tocilizumab (MRA) for binding to IL-6R; and in step d), the set, collection or library of nucleic acid sequences is screened for nucleic acid sequences that encode (i) an amino acid sequence that can bind to and/or has affinity for the M182 binding site on IL-6R and/or (ii) an amino acid sequence that can compete with M182 for binding to the IL-6R.

Alternatively, the first amino acid sequence obtained in step b) is preferably such that (i) it can bind to and/or has affinity for the M182 binding site on IL-6R and/or (ii) competes with M182 for binding to the IL-6R; and in step d), the set, collection or library of nucleic acid sequences is screened for nucleic acid sequences that encode (i) an amino acid sequence that can bind to and/or has affinity for the Tocilizumab (MRA) binding site on IL-6R (and in particular one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or (ii) an amino acid sequence that can compete with Tocilizumab (MRA) for binding to IL-6R.

In another preferred aspect of the above method, the first amino acid sequence obtained in step b) is preferably such that (i) it can bind to and/or has affinity for the Tocilizumab (MRA) binding site on IL-6R (and in particular one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or (ii) competes with Tocilizumab (MRA) for binding to IL-6R; and in step d), the set, collection or library of nucleic acid sequences is screened for nucleic acid sequences that encode (i) an amino acid sequence that can bind to and/or has affinity for the BN-12 binding site on IL-6R and/or (ii) an amino acid sequence that can compete with BN-12 for binding to the IL-6R.

Alternatively, the first amino acid sequence obtained in step b) is preferably such that (i) it can bind to and/or has affinity for the BN-12 binding site on IL-6R and/or (ii) competes with BN-12 for binding to the IL-6R; and in step d), the set, collection or library of nucleic acid sequences is screened for nucleic acid sequences that encode (i) an amino acid sequence that can bind to and/or has affinity for the Tocilizumab (MRA) binding site on IL-6R (and in particular one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or (ii) an amino acid sequence that can compete with Tocilizumab (MRA) for binding to IL-6R.

In another preferred aspect of the above method, the first amino acid sequence obtained in step b) is preferably such that (i) it can bind to and/or has affinity for the BN-12 binding site on IL-6R and/or (ii) competes with BN-12 for binding to IL-6R; and in step d), the set, collection or library of nucleic acid sequences is screened for nucleic acid sequences that encode (i) an amino acid sequence that can bind to and/or has affinity for the gp130 binding site on IL-6R or the IL-6/IL-6R complex and/or (ii) an amino acid sequence that can compete with gp130 for binding to the IL-6/IL-6R complex.

Alternatively, the first amino acid sequence obtained in step b) is preferably such that (i) it can bind to and/or has affinity for the gp130 binding site on IL-6R and/or the IL-6/IL-6R complex and/or (ii) competes with gp130 for binding to the IL-6/IL-6R complex; and in step d), the set, collection or library of nucleic acid sequences is screened for nucleic acid sequences that encode (i) an amino acid sequence that can bind to and/or has affinity for the BN-12 binding site on IL-6R and/or (ii) an amino acid sequence that can compete with BN-12 for binding to IL-6R.

In another preferred aspect of the above method, the first amino acid sequence obtained in step b) is preferably such that (1) it can bind to and/or has affinity for the BN-12 binding site on IL-6R and/or (ii) competes with BN-12 for binding to IL-6R; and in step d), the set, collection or library of nucleic acid sequences is screened for nucleic acid sequences that encode (i) an amino acid sequence that can bind to and/or has affinity for the M182 binding site on IL-6R and/or (ii) an amino acid sequence that can compete with M182 for binding to the IL-6R.

Alternatively, the first amino acid sequence obtained in step b) is preferably such that (i) it can bind to and/or has affinity for the M182 binding site on IL-6R and/or (ii) competes with M182 for binding to the IL-6R; and in step d), the set, collection or library of nucleic acid sequences is screened for nucleic acid sequences that encode (i) an amino acid sequence that can bind to and/or has affinity for the BN-12 binding site on IL-6R and/or (ii) an amino acid sequence that can compete with BN-12 for binding to IL-6R.

In the above methods, screening or selecting for (nucleic acid sequences that encode) amino acid sequences that compete with IL-6, gp130, Tocilizumab (MRA), BN-12 or M182, respectively, may be performed using generally known methods for screening or selecting for competitors of known binding molecules, which may for example involve performing the screening or selection in the presence of the binding molecule and/or determining the binding affinity of the compound(s) to be screened in the presence of the binding molecule.

It is also possible, in step d), to screen for nucleic acid sequences that both (i) encode an amino acid sequence that can bind to and/or has affinity for theft-6 binding site on IL-6R (and in particular one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or that can compete with IL-6 for binding to IL-6R; and that also (ii) encode an amino acid sequence that can bind to and/or has affinity for the gp130 binding site on IL-6R and/or the IL-6/IL-6R complex and/or that can compete with gp130 for binding to the IL-6/IL-6R complex. Again, this may be performed in separate steps or a single step, and by selecting or screening in the presence of IL-6 and/or gp130, as applicable.

It is also possible, in step d), to screen for nucleic acid sequences that both (i) encode an amino acid sequence that can bind to and/or has affinity for the IL-6 binding site on IL-6R (and in particular one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or that can compete with IL-6 for binding to IL-6R; and that also (ii) encode an amino acid sequence that can bind to and/or has affinity for the M182 binding site on IL-6R and/or that can compete with M182 for binding to IL-6R. Again, this may be performed in separate steps or a single step, and by selecting or screening in the presence of IL-6 and/or M182, as applicable.

It is also possible, in step d), to screen for nucleic acid sequences that both (i) encode an amino acid sequence that can bind to and/or has affinity for the IL-6 binding site on IL-6R (and in particular one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or that can compete with IL-6 for binding to IL-6R; and that also (ii) encode an amino acid sequence that can bind to and/or has affinity for the BN-12 binding site on IL-6R and/or that can compete with BN-12 for binding to IL-6R. Again, this may be performed in separate steps or a single step, and by selecting or screening in the presence of IL-6 and/or BN-12, as applicable.

It is also possible, in step d), to screen for nucleic acid sequences that both (i) encode an amino acid sequence that can bind to and/or has affinity for the Tocilizumab (MRA) binding site on IL-6R (and in particular one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or that can compete with Tocilizumab (MRA) for binding to IL-6R; and that also (ii) encode an amino acid sequence that can bind to and/or has affinity for the gp130 binding site on IL-6R and/or the IL-6/IL-6R complex and/or that can compete with gp130 for binding to the IL-6/IL-6R complex. Again, this may be performed in separate steps or a single step, and by selecting or screening in the presence of Tocilizumab (MRA) and/or gp130, as applicable.

It is also possible, in step d), to screen for nucleic acid sequences that both (i) encode an amino acid sequence that can bind to and/or has affinity for the Tocilizumab (MRA) binding site on IL-6R (and in particular one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or that can compete with Tocilizumab (MRA) for binding to IL-6R; and that also (ii) encode an amino acid sequence that can bind to and/or has affinity for the M182 binding site on IL-6R and/or that can compete with M182 for binding to IL-6R. Again, this may be performed in separate steps or a single step, and by selecting or screening in the presence of Tocilizumab (MRA) and/or M182, as applicable.

It is also possible, in step d), to screen for nucleic acid sequences that both (i) encode an amino acid sequence that can bind to and/or has affinity for the Tocilizumab (MRA) binding site on IL-6R (and in particular one or more of the 18 contact residues as described in Boulanger et al. 2003 (Science 300, 2101-2104) present in the extracellular D3 domain of the IL-6R, more preferably amino acid residues Phe229 and Phe279 present in the extracellular D3 domain of the IL-6R) and/or that can compete with Tocilizumab (MRA) for binding to IL-6R; and that also (ii) encode an amino acid sequence that can bind to and/or has affinity for the BN-12 binding site on IL-6R and/or that can compete with BN-12 for binding to IL-6R. Again, this may be performed in separate steps or a single step, and by selecting or screening in the presence of Tocilizumab (MRA) and/or BN-12, as applicable.

It is also possible, in step d), to screen for nucleic acid sequences that both (1) encode an amino acid sequence that can bind to and/or has affinity for the BN-12 binding site on IL-6R and/or that can compete with BN-12 for binding to IL-6R; and that also (ii) encode an amino acid sequence that can bind to and/or has affinity for the gp130 binding site on IL-6R and/or the IL-6/IL-6R complex and/or that can compete with gp130 for binding to the IL-6/IL-6R complex. Again, this may be performed in separate steps or a single step, and by selecting or screening in the presence of Bn-12 and/or gp130, as applicable.

It is also possible, in step d), to screen for nucleic acid sequences that both (i) encode an amino acid sequence that can bind to and/or has affinity for the BN-12 binding site on IL-6R and/or that can compete with BN-12 for binding to IL-6R; and that also (ii) encode an amino acid sequence that can bind to and/or has affinity for the M182 binding site on IL-6R and/or that can compete with M182 for binding to IL-6R. Again, this may be performed in separate steps or a single step, and by selecting or screening in the presence of BN-12 and/or M182, as applicable.

The nucleic acid sequence encoding the biparatopic polypeptide obtained in the method above can subsequently be fused to one or more further sets, collections or libraries of nucleic acid sequences encoding amino acid sequences that can bind to and/or have affinity for IL-6R in order to obtain a triparatopic or multiparatopic amino acid sequence respectively.

In such a method, the set, collection or library of nucleic acid sequences encoding amino acid sequences may for example be a set, collection or library of nucleic acid sequences encoding a naïve set, collection or library of immunoglobulin sequences; a set, collection or library of nucleic acid sequences encoding a synthetic or semi-synthetic set, collection or library of immunoglobulin sequences; and/or a set, collection or library of nucleic acid sequences encoding a set, collection or library of immunoglobulin sequences that have been subjected to affinity maturation.

The set, collection or library of nucleic acid sequences that encode an amino acid sequence that can bind to and/or has affinity for IL-6R can be obtained by any selection or screening method known in the art for the selection and/or screening of nucleic acid sequences that encode an amino acid sequence that can bind to and/or has affinity for IL-6R and as, for example, described in the Examples section.

Also, in such a method, the set, collection or library of nucleic acid sequences may encode a set, collection or library of heavy chain variable domains (such as $V_H$ domains or $V_{HH}$ domains) or of light chain variable domains. For example, the set, collection or library of nucleic acid sequences may encode a set, collection or library of domain antibodies or single domain antibodies, or a set, collection or library of amino acid sequences that are capable of functioning as a domain antibody or single domain antibody.

In a preferred aspect of this method, the set, collection or library of nucleic acid sequences may be an immune set, collection or library of nucleic acid sequences, for example derived from a mammal that has been suitably immunized with IL-6R or with a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

The set, collection or library of nucleic acid sequences may for example encode an immune set, collection or library of heavy chain variable domains or of light chain variable domains. In one specific aspect, the set, collection or library of nucleotide sequences may encode a set, collection or library of $V_{HH}$ sequences.

In the above methods, the nucleic acid sequence may be displayed on a phage, phagemid, ribosome or suitable micro-organism (such as yeast), such as to facilitate screening. Suitable methods, techniques and host organisms for displaying and screening (a set, collection or library of) nucleotide sequences encoding amino acid sequences will be clear to the person skilled in the art, for example on the basis of the further disclosure herein. Reference is also made to the review by Hoogenboom in Nature Biotechnology, 23, 9, 1105-1116 (2005).

As will be clear to the skilled person, the screening step of the methods described herein can also be performed as a selection step. Accordingly the term "screening" as used in the present description can comprise selection, screening or any suitable combination of selection and/or screening techniques. Also, when a set, collection or library of sequences is used, it may contain any suitable number of sequences, such as 1, 2, 3 or about 5, 10, 50, 100, 500, 1000, 5000, $10^4$, $10^5$, $10^6$, $10^7$, $10^8$ or more sequences.

Also, one or more or all of the sequences in the above set, collection or library of amino acid sequences may be obtained or defined by rational, or semi-empirical approaches such as computer modelling techniques or biostatics or datamining techniques.

Furthermore, such a set, collection or library can comprise one, two or more sequences that are variants from one another (e.g. with designed point mutations or with randomized positions), compromise multiple sequences derived from a diverse set of naturally diversified sequences (e.g. an immune library), or any other source of diverse sequences (as described for example in Hoogenboom et al. (Nat Biotechnol 23:1105, 2005) and Binz et al. (Nat Biotechnol 2005, 23:1247)). Such set, collection or library of sequences can be displayed on the surface of a phage particle, a ribosome, a bacterium, a yeast cell, a mammalian cell, and linked to the nucleotide sequence encoding the amino acid sequence within these carriers. This makes such set, collection or library amenable to selection procedures to isolate the desired amino acid sequences of the invention. More generally, when a sequence is displayed on a suitable host or host cell, it is also possible (and customary) to first isolate from said host or host cell a nucleotide sequence that encodes the desired sequence, and then to obtain the desired sequence by suitably expressing said nucleotide sequence in a suitable host organism. Again, this can be performed in any suitable manner known per se, as will be clear to the skilled person.

The invention also relates to the biparatopic polypeptides that are obtained by the above methods, or alternatively by a method that comprises one of the above methods and in addition at least the steps of determining the nucleotide sequence or amino acid sequence; and of expressing or synthesizing said amino acid sequence in a manner known per se, such as by expression in a suitable host cell or host organism or by chemical synthesis.

Another aspect of this invention relates to a nucleic acid that encodes an amino acid sequence of the invention (such as a Nanobody of the invention) or a polypeptide of the invention comprising the same. Again, as generally described herein for the nucleic acids of the invention, such a nucleic acid may be in the form of a genetic construct, as defined herein.

In another aspect, the invention relates to host or host cell that expresses or that is capable of expressing an amino acid sequence (such as a Nanobody) of the invention and/or a polypeptide of the invention comprising the same; and/or that contains a nucleic acid of the invention. Some preferred but non-limiting examples of such hosts or host cells will become clear from the further description herein.

Another aspect of the invention relates to a product or composition containing or comprising at least one amino acid sequence and/or Nanobody of the invention, at least one polypeptide of the invention and/or at least one nucleic acid of the invention, and optionally one or more further components of such compositions known per se, i.e. depending on the intended use of the composition. Such a product or composition may for example be a pharmaceutical composition (as described herein), a veterinary composition or a product or composition for diagnostic use (as also described herein). Some preferred but non-limiting examples of such products or compositions will become clear from the further description herein.

Generally, it should be noted that the term Nanobody as used herein in its broadest sense is not limited to a specific biological source or to a specific method of preparation. For example, as will be discussed in more detail below, the Nanobodies of the invention can generally be obtained by any of the techniques (1) to (8) mentioned on pages 61 and 62 of WO 08/020,079, or any other suitable technique known per se. One preferred class of Nanobodies corresponds to the $V_{HH}$ domains of naturally occurring heavy chain antibodies directed against IL-6R. As further described herein, such $V_{HH}$ sequences can generally be generated or obtained by suitably immunizing a species of Camelid with IL-6R (i.e. so as to raise an immune response and/or heavy chain antibodies directed against IL-6R), by obtaining a suitable biological sample from said Camelid (such as a blood sample, serum sample or sample of B-cells), and by generating $V_{HH}$ sequences directed against IL-6R, starting from said sample, using any suitable technique known per se. Such techniques will be clear to the skilled person and/or are further described herein.

Alternatively, such naturally occurring $V_{HH}$ domains against IL-6R, can be obtained from naïve libraries of Camelid $V_{HH}$ sequences, for example by screening such a library using IL-6R, or at least one part, fragment, antigenic determinant or epitope thereof using one or more screening techniques known per se. Such libraries and techniques are for example described in WO 99/37681, WO 01/90190, WO 03/025020 and WO 03/035694. Alternatively, improved synthetic or semi-synthetic libraries derived from naïve $V_{HH}$ libraries may be used, such as $V_{HH}$ libraries obtained from naïve $V_{HH}$ libraries by techniques such as random mutagenesis and/or CDR shuffling, as for example described in WO 00/43507.

As mentioned herein, a particularly preferred class of Nanobodies of the invention comprises Nanobodies with an amino acid sequence that corresponds to the amino acid sequence of a naturally occurring $V_{HH}$ domain, but that has been "humanized", i.e. by replacing one or more amino acid residues in the amino acid sequence of said naturally occurring $V_{HH}$ sequence (and in particular in the framework sequences) by one or more of the amino acid residues that occur at the corresponding position(s) in a $V_H$ domain from a conventional 4-chain antibody from a human being (e.g. indicated above), as further described on, and using the techniques mentioned on, page 63 of WO 08/020,079. Another particularly preferred class of Nanobodies of the invention comprises Nanobodies with an amino acid sequence that corresponds to the amino acid sequence of a naturally occurring $V_H$ domain, but that has been "camelized", i.e. by replacing one or more amino acid residues in the amino acid sequence of a naturally occurring $V_H$ domain from a conventional 4-chain antibody by one or more of the amino acid residues that occur at the corresponding position(s) in a $V_{HH}$ domain of a heavy chain antibody, as further described on, and using the techniques mentioned on, page 63 of WO 08/020,079.

Other suitable methods and techniques for obtaining the Nanobodies of the invention and/or nucleic acids encoding the same, starting from naturally occurring $V_H$ sequences or preferably $V_{HH}$ sequences, will be clear from the skilled person, and may for example include the techniques that are mentioned on page 64 of WO 08/00279As mentioned herein, Nanobodies may in particular be characterized by the presence of one or more "Hallmark residues" (as described herein) in one or more of the framework sequences.

Thus, according to one preferred, but non-limiting aspect of the invention, a Nanobody in its broadest sense can be generally defined as a polypeptide comprising:
a) an amino acid sequence that is comprised of four framework regions/sequences interrupted by three complementarity determining regions/sequences, in which the amino acid residue at position 108 according to the Kabat numbering is Q;
and/or:
b) an amino acid sequence that is comprised of four framework regions/sequences interrupted by three complementarity determining regions/sequences, in which the amino acid residue at position 45 according to the Kabat numbering is a charged amino acid (as defined herein) or a cysteine residue, and position 44 is preferably an E;
and/or:
c) an amino acid sequence that is comprised of four framework regions/sequences interrupted by three complementarity determining regions/sequences, in which the amino acid residue at position 103 according to the Kabat numbering is chosen from the group consisting of P, R and 5, and is in particular chosen from the group consisting of R and S.

Thus, in a first preferred, but non-limiting aspect, a Nanobody of the invention may have the structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which
a) the amino acid residue at position 108 according to the Kabat numbering is Q;
and/or in which:
b) the amino acid residue at position 45 according to the Kabat numbering is a charged amino acid or a cysteine and the amino acid residue at position 44 according to the Kabat numbering is preferably E;
and/or in which:
c) the amino acid residue at position 103 according to the Kabat numbering is chosen from the group consisting of P, R and S, and is in particular chosen from the group consisting of R and 5;
and in which:
d) CDR1, CDR2 and CDR3 are as defined herein, and are preferably as defined according to one of the preferred aspects herein, and are more preferably as defined according to one of the more preferred aspects herein.

In particular, a Nanobody in its broadest sense can be generally defined as a polypeptide comprising:
a) an amino acid sequence that is comprised of four framework regions/sequences interrupted by three complementarity determining regions/sequences, in which the amino acid residue at position 108 according to the Kabat numbering is Q;
and/or:
b) an amino acid sequence that is comprised of four framework regions/sequences interrupted by three complementarity determining regions/sequences, in which the amino acid residue at position 44 according to the Kabat numbering is E and in which the amino acid residue at position 45 according to the Kabat numbering is an R;
and/or:
c) an amino acid sequence that is comprised of four framework regions/sequences interrupted by three complementarity determining regions/sequences, in which the amino acid residue at position 103 according to the Kabat numbering is chosen from the group consisting of P, R and 5, and is in particular chosen from the group consisting of R and S.

Thus, according to a preferred, but non-limiting aspect, a Nanobody of the invention may have the structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which
a) the amino acid residue at position 108 according to the Kabat numbering is Q;
and/or in which:
b) the amino acid residue at position 44 according to the Kabat numbering is E and in which the amino acid residue at position 45 according to the Kabat numbering is an R;
and/or in which:
c) the amino acid residue at position 103 according to the Kabat numbering is chosen from the group consisting of P, R and S, and is in particular chosen from the group consisting of R and 5;
and in which:
d) CDR1, CDR2 and CDR3 are as defined herein, and are preferably as defined according to one of the preferred aspects herein, and are more preferably as defined according to one of the more preferred aspects herein.

In particular, a Nanobody against IL-6R according to the invention may have the structure:

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which
a) the amino acid residue at position 108 according to the Kabat numbering is Q;
and/or in which:
b) the amino acid residue at position 44 according to the Kabat numbering is E and in which the amino acid residue at position 45 according to the Kabat numbering is an R;
and/or in which:
c) the amino acid residue at position 103 according to the Kabat numbering is chosen from the group consisting of P, R and S, and is in particular chosen from the group consisting of R and S;
and in which:
d) CDR1, CDR2 and CDR3 are as defined herein, and are preferably as defined according to one of the preferred aspects herein, and are more preferably as defined according to one of the more preferred aspects herein.

In particular, according to one preferred, but non-limiting aspect of the invention, a Nanobody can generally be defined as a polypeptide comprising an amino acid sequence that is comprised of four framework regions/sequences interrupted by three complementarity determining regions/sequences, in which;

a-1) the amino acid residue at position 44 according to the Kabat numbering is chosen from the group consisting of A, G, E, D, G, Q, R, S, L; and is preferably chosen from the group consisting of G, E or Q; and a-2) the amino acid residue at position 45 according to the Kabat numbering is chosen from the group consisting of L, R or C; and is preferably chosen from the group consisting of L or R; and a-3) the amino acid residue at position 103 according to the Kabat numbering is chosen from the group consisting of W, R or 5; and is preferably W or R, and is most preferably W;

a-4) the amino acid residue at position 108 according to the Kabat numbering is Q;

or in which:

b-1) the amino acid residue at position 44 according to the Kabat numbering is chosen from the group consisting of E and Q; and b-2) the amino acid residue at position 45 according to the Kabat numbering is R; and b-3) the amino acid residue at position 103 according to the Kabat numbering is chosen from the group consisting of W, R and 5; and is preferably W;

b-4) the amino acid residue at position 108 according to the Kabat numbering is chosen from the group consisting of Q and L; and is preferably Q;

or in which:

c-1) the amino acid residue at position 44 according to the Kabat numbering is chosen from the group consisting of A, G, E, D, Q, R, S and L; and is preferably chosen from the group consisting of G, E and Q; and c-2) the amino acid residue at position 45 according to the Kabat numbering is chosen from the group consisting of L, R and C; and is preferably chosen from the group consisting of L and R; and c-3) the amino acid residue at position 103 according to the Kabat numbering is chosen from the group consisting of P, R and 5; and is in particular chosen from the group consisting of R and 5; and c-4) the amino acid residue at position 108 according to the Kabat numbering is chosen from the group consisting of Q and L; is preferably Q;

and in which d) CDR1, CDR2 and CDR3 are as defined herein, and are preferably as defined according to one of the preferred aspects herein, and are more preferably as defined according to one of the more preferred aspects herein.

Thus, in another preferred, but non-limiting aspect, a Nanobody of the invention may have the structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which:

a-1) the amino acid residue at position 44 according to the Kabat numbering is chosen from the group consisting of A, G, E, Q, G, Q, R, S, L; and is preferably chosen from the group consisting of G, E or Q;

and in which:

a-2) the amino acid residue at position 45 according to the Kabat numbering is chosen from the group consisting of L, R or C; and is preferably chosen from the group consisting of L or R;

and in which:

a-3) the amino add residue at position 103 according to the Kabat numbering is chosen from the group consisting of W, R or 5; and is preferably W or R, and is most preferably W;

and in which a-4) the amino acid residue at position 108 according to the Kabat numbering is Q;

and in which:

d) CDR1, CDR2 and CDR3 are as defined herein, and are preferably as defined according to one of the preferred aspects herein, and are more preferably as defined according to one of the more preferred aspects herein.

In another preferred, but non-limiting aspect, a Nanobody of the invention may have the structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which:

b-1) the amino acid residue at position 44 according to the Kabat numbering is chosen from the group consisting of E and Q;

and in which:

b-2) the amino acid residue at position 45 according to the Kabat numbering is R;

and in which:

b-3) the amino acid residue at position 103 according to the Kabat numbering is chosen from the group consisting of W, R and S; and is preferably W;

and in which:

b-4) the amino acid residue at position 108 according to the Kabat numbering is chosen from the group consisting of Q and L; and is preferably Q;

and in which:

d) CDR1, CDR2 and CDR3 are as defined herein, and are preferably as defined according to one of the preferred aspects herein, and are more preferably as defined according to one of the more preferred aspects herein.

In another preferred, but non-limiting aspect, a Nanobody of the invention may have the structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which:

c-1) the amino acid residue at position 44 according to the Kabat numbering is chosen from the group consisting of A, G, E, D, Q, R, S and L; and is preferably chosen from the group consisting of G, E and Q;

and in which:

c-2) the amino acid residue at position 45 according to the Kabat numbering is chosen from the group consisting of L, R and C; and is preferably chosen from the group consisting of L and R;

and in which:

c-3) the amino acid residue at position 103 according to the Kabat numbering is chosen from the group consisting of P, R and S; and is in particular chosen from the group consisting of R and 5;

and in which:

c-4) the amino acid residue at position 108 according to the Kabat numbering is chosen from the group consisting of Q and L; is preferably Q;

and in which:

d) CDR1, CDR2 and CDR3 are as defined herein, and are preferably as defined according to one of the preferred aspects herein, and are more preferably as defined according to one of the more preferred aspects herein.

Two particularly preferred, but non-limiting groups of the Nanobodies of the invention are those according to a) above; according to (a-1) to (a-4) above; according to b) above; according to (b-1) to (b-4) above; according to (c) above; and/or according to (c-1) to (c-4) above, in which either:

i) the amino acid residues at positions 44-47 according to the Kabat numbering form the sequence GLEW (or a GLEW-like sequence as described herein) and the amino acid residue at position 108 is Q;

or in which:

ii) the amino acid residues at positions 43-46 according to the Kabat numbering form the sequence KERE or KQRE (or a KERE-like sequence as described) and the amino acid residue at position 108 is Q or L, and is preferably Q.

Thus, in another preferred, but non-limiting aspect, a Nanobody of the invention may have the structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which:

i) the amino add residues at positions 44-47 according to the Kabat numbering form the sequence GLEW (or a GLEW-Like sequence as defined herein) and the amino acid residue at position 108 is Q;

and in which:

ii) CDR1, CDR2 and CDR3 are as defined herein, and are preferably as defined according to one of the preferred aspects herein, and are more preferably as defined according to one of the more preferred aspects herein.

In another preferred, but non-limiting aspect, a Nanobody of the invention may have the structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which:

i) the amino acid residues at positions 43-46 according to the Kabat numbering form the sequence KERE or KQRE (or a KERE-like sequence) and the amino acid residue at position 108 is Q or L, and is preferably Q;

and in which:

ii) CDR1, CDR2 and CDR3 are as defined herein, and are preferably as defined according to one of the preferred aspects herein, and are more preferably as defined according to one of the more preferred aspects herein.

In the Nanobodies of the invention in which the amino acid residues at positions 43-46 according to the Kabat numbering form the sequence KERE or KQRE, the amino acid residue at position 37 is most preferably F. In the Nanobodies of the invention in which the amino acid residues at positions 44-47 according to the Kabat numbering form the sequence GLEW, the amino acid residue at position 37 is chosen from the group consisting of Y, H, I, L, V or F, and is most preferably V.

Thus, without being limited hereto in any way, on the basis of the amino acid residues present on the positions mentioned above, the Nanobodies of the invention can generally be classified on the basis of the following three groups:

i) The "GLEW-group": Nanobodies with the amino acid sequence GLEW at positions 44-47 according to the Kabat numbering and Q at position 108 according to the Kabat numbering. As further described herein, Nanobodies within this group usually have a V at position 37, and can have a W, P, R or S at position 103, and preferably have a W at position 103. The GLEW group also comprises some GLEW-like sequences such as those mentioned in Table B-2 below. More generally, and without limitation, Nanobodies belonging to the GLEW-group can be defined as Nanobodies with a G at position 44 and/or with a W at position 47, in which position 46 is usually E and in which preferably position 45 is not a charged amino acid residue and not cysteine;

ii) The "KERE-group": Nanobodies with the amino acid sequence KERE or KQRE (or another KERE-like sequence) at positions 43-46 according to the Kabat numbering and Q or L at position 108 according to the Kabat numbering. As further described herein, Nanobodies within this group usually have a F at position 37, an L or F at position 47; and can have a W, P, R or S at position 103, and preferably have a W at position 103. More generally, and without limitation, Nanobodies belonging to the KERE-group can be defined as Nanobodies with a K, Q or R at position 44 (usually K) in which position 45 is a charged amino acid residue or cysteine, and position 47 is as further defined herein;

iii) The "103 P, R, S-group": Nanobodies with a P, R or S at position 103. These Nanobodies can have either the amino acid sequence GLEW at positions 44-47 according to the Kabat numbering or the amino acid sequence KERE or KQRE at positions 43-46 according to the Kabat numbering, the latter most preferably in combination with an F at position 37 and an L or an F at position 47 (as defined for the KERE-group); and can have Q or L at position 108 according to the Kabat numbering, and preferably have Q.

Also, where appropriate, Nanobodies may belong to (i.e. have characteristics of) two or more of these classes. For example, one specifically preferred group of Nanobodies has GLEW or a GLEW-like sequence at positions 44-47; P, R or S (and in particular R) at position 103; and Q at position 108 (which may be humanized to L).

More generally, it should be noted that the definitions referred to above describe and apply to Nanobodies in the form of a native (i.e. non-humanized) $V_{HH}$ sequence, and that humanized variants of these Nanobodies may contain other amino acid residues than those indicated above (i.e. one or more humanizing substitutions as defined herein). For example, and without limitation, in some humanized Nanobodies of the GLEW-group or the 103 P, R, S-group, Q at position 108 may be humanized to 108L. As already mentioned herein, other humanizing substitutions (and suitable combinations thereof) will become clear to the skilled person based on the disclosure herein. In addition, or alternatively, other potentially useful humanizing substitutions can be ascertained by comparing the sequence of the framework regions of a naturally occurring $V_{HH}$ sequence with the corresponding framework sequence of one or more closely related human $V_H$ sequences, after which one or more of the potentially useful humanizing substitutions (or combinations thereof) thus determined can be introduced into said $V_{HH}$ sequence (in any manner known per se, as further described herein) and the resulting humanized $V_{HH}$ sequences can be tested for affinity for the target, for stability, for ease and level of expression, and/or for other desired properties. In this way, by means of a limited degree of trial and error, other suitable humanizing substitutions (or suitable combinations thereof) can be determined by the skilled person based on the disclosure herein. Also, based on the foregoing, (the framework regions of) a Nanobody may be partially humanized or fully humanized.

Thus, in another preferred, but non-limiting aspect, a Nanobody of the invention may be a Nanobody belonging to the CLEW-group (as defined herein), and in which CDR1, CDR2 and CDR3 are as defined herein, and are preferably as defined according to one of the preferred aspects herein, and are more preferably as defined according to one of the more preferred aspects herein.

In another preferred, but non-limiting aspect, a Nanobody of the invention may be a Nanobody belonging to the KERE-group (as defined herein), and CDR1, CDR2 and CDR3 are as defined herein, and are preferably as defined according to one of the preferred aspects herein, and are more preferably as defined according to one of the more preferred aspects herein.

Thus, in another preferred, but non-limiting aspect, a Nanobody of the invention may be a Nanobody belonging to the 103 P, R, S-group (as defined herein), and in which CDR1, CDR2 and CDR3 are as defined herein, and are preferably as defined according to one of the preferred aspects herein, and are more preferably as defined according to one of the more preferred aspects herein.

Also, more generally and in addition to the 108Q, 43E/44R and 103 P, R, S residues mentioned above, the Nanobodies of the invention can contain, at one or more positions that in a conventional $V_H$ domain would form (part of) the $V_H/V_L$ interface, one or more amino acid residues that are more highly charged than the amino acid residues that naturally occur at the same position(s) in the corresponding naturally occurring $V_H$ sequence, and in particular one or more charged amino acid residues (as mentioned in Table A-2 on page 48 of the International application WO 08/020, 079). Such substitutions include, but are not limited to, the CLEW-like sequences mentioned in Table B-2 below; as well as the substitutions that are described in the International Application WO 00/29004 for so-called "microbodies", e.g. so as to obtain a Nanobody with Q at position 108 in combination with KLEW at positions 44-47. Other possible substitutions at these positions will be clear to the skilled person based upon the disclosure herein.

In one aspect of the Nanobodies of the invention, the amino acid residue at position 83 is chosen from the group consisting of L, M, S, V and W; and is preferably L.

Also, in one aspect of the Nanobodies of the invention, the amino acid residue at position 83 is chosen from the group consisting of R, K, N, E, G, I, T and 0; and is most preferably either K or E (for Nanobodies corresponding to naturally occurring $V_{HH}$ domains) or R (for "humanized" Nanobodies, as described herein). The amino acid residue at position 84 is chosen from the group consisting of P, A, R, S, D T, and V in one aspect, and is most preferably P (for Nanobodies corresponding to naturally occurring $V_{HH}$ domains) or R (for "humanized" Nanobodies, as described herein).

Furthermore, in one aspect of the Nanobodies of the invention, the amino acid residue at position 104 is chosen from the group consisting of G and D; and is most preferably G.

Collectively, the amino acid residues at positions 11, 37, 44, 45, 47, 83, 84, 103, 104 and 108, which in the Nanobodies are as mentioned above, will also be referred to herein as the "Hallmark Residues". The Hallmark Residues and the amino acid residues at the corresponding positions of the most closely related human $V_H$ domain, $V_H3$, are summarized in Table B-2.

Some especially preferred but non-limiting combinations of these Hallmark Residues as occur in naturally occurring $V_{HH}$ domains are mentioned in Table 8-3. For comparison, the corresponding amino acid residues of the human $V_H3$ called DP-47 have been indicated in italics.

TABLE B-2

Hallmark Residues in Nanobodies

| Position | Human $V_H3$ | Hallmark Residues |
|---|---|---|
| 11 | L, V; predominantly L | L, S, V, M, W, F, T, Q, E, A, R, G, K, Y, N, P, I; preferably L |
| 37 | V, I, F; usually V | $F^{(1)}$, Y, V, L, A, H, S, I, W, C, N, G, D, T, P, preferably $F^{(1)}$ or Y |
| 44[8] | G | $E^{(3)}$, $Q^{(3)}$, $G^{(2)}$, D, A, K, R, L, P, S, V, H, T, N, W, M, I; preferably $G^{(2)}$, $E^{(3)}$ or $Q^{(3)}$; most preferably $G^{(2)}$ or $Q^{(3)}$ |
| 45[8] | L | $L^{(2)}$, $R^{(3)}$, P, H, F, G, Q, S, E, T, Y, C, I, D, V; preferably $L^{(2)}$ or $R^{(3)}$ |
| 47[8] | W, Y | $F^{(1)}$, $L^{(1)}$ or $W^{(2)}$ G, I, S, A, V, M, R, Y, E, P, T, C, H, K, Q, N, D; preferably $W^{(2)}$, $L^{(1)}$ or $F^{(1)}$ |
| 83 | R or K; usually R | R, $K^{(5)}$, T, $E^{(5)}$, Q, N, S, I, V, G, M, L, A, D, Y, H; preferably K or R; most preferably K |
| 84 | A, T, D; predominantly A | $P^{(5)}$, S, H, L, A, V, I, T, F, D, R, Y, N, Q, G, E; preferably P |
| 103 | W | $W^{(4)}$, $R^{(6)}$, G, S, K, A, M, Y, L, F, T, N, V, Q, $P^{(6)}$, E, C; preferably W |
| 104 | G | G, A, S, T, D, P, N, E, C, L; preferably G |
| 108 | L, M or T; predominantly L | Q, $L^{(7)}$, R, P, E, K, S, T, M, A, H; preferably Q or $L^{(7)}$ |

Notes:
[1] In particular, but not exclusively, in combination with KERE or KQRE at positions 43-46.
[2] Usually as GLEW at positions 44-47.
[3] Usually as KERE or KQRE at positions 43-46, e.g. as KEREL, KEREF, KQREL, KQREF, KEREG, KQREW or KQREG at positions 43-47. Alternatively, also sequences such as TERE (for example TEREL), TQRE (for example TQREL), KECE (for example KECEL or KECER), KQCE (for example KQCEL), RERE (for example REREG), RQRE (for example RQREL, RQREF or RQREW), QERE (for example QEREG), QQRE, (for example QQREW, QQREL or QQREF), KGRE (for example KGREG), KDRE (for example KDREV) are possible. Some other possible, but less preferred sequences include for example DECKL and NVCEL.
[4] With both GLEW at positions 44-47 and KERE or KQRE at positions 43-46.
[5] Often as KP or EP at positions 83-84 of naturally occurring $V_{HH}$ domains.
[6] In particular, but not exclusively, in combination with GLEW at positions 44-47.
[7] With the proviso that when positions 44-47 are GLEW, position 108 is always Q in (non-humanized) $V_{HH}$ sequences that also contain a W at 103.
[8] The GLEW group also contains GLEW-like sequences at positions 44-47, such as for example GVEW, EPEW, GLER, DQEW, DLEW, GIEW, ELEW, GPEW, EWLP, GPER, GLER and ELEW.

TABLE B-3

Some preferred but non-limiting combinations of Hallmark Residues in naturally occurring Nanobodies.

| | 11 | 37 | 44 | 45 | 47 | 83 | 84 | 103 | 104 | 108 |
|---|---|---|---|---|---|---|---|---|---|---|
| DP-47 (human) | M | V | G | L | W | R | A | W | G | L |
| "KERE" group | L | F | E | R | L | K | P | W | G | Q |
| | L | F | E | R | F | E | P | W | G | Q |
| | L | F | E | R | F | K | P | W | G | Q |
| | L | Y | Q | R | L | K | P | W | G | Q |
| | L | F | L | R | V | K | P | Q | G | Q |
| | L | F | Q | R | L | K | P | W | G | Q |
| | L | F | E | R | F | K | P | W | G | Q |
| "GLEW" group | L | V | G | L | W | K | S | W | G | Q |
| | M | V | G | L | W | K | P | R | G | Q |

For humanization of these combinations, reference is made to the specification.

In the Nanobodies, each amino acid residue at any other position than the Hallmark Residues can be any amino acid residue that naturally occurs at the corresponding position (according to the Kabat numbering) of a naturally occurring $V_{HH}$ domain.

Such amino acid residues will be clear to the skilled person. Tables 8-4 to 8-7 mention some non-limiting residues that can be present at each position (according to the Kabat numbering) of the FR1, FR2, FR3 and FR4 of naturally occurring $V_{HH}$ domains. For each position, the amino acid residue that most frequently occurs at each position of a naturally occurring $V_{HH}$ domain (and which is the most preferred amino acid residue for said position in a Nanobody) is indicated in bold; and other preferred amino acid residues for each position have been underlined (note: the number of amino acid residues that are found at positions 26-30 of naturally occurring $V_{HH}$ domains supports the hypothesis underlying the numbering by Chothia (supra) that the residues at these positions already form part of CDR1).

In Tables B-4-B-7, some of the non-limiting residues that can be present at each position of a human $V_H3$ domain have also been mentioned. Again, for each position, the amino acid residue that most frequently occurs at each position of a naturally occurring human $V_H3$ domain is indicated in bold; and other preferred amino acid residues have been underlined.

For reference only, Tables B-4-B-7 also contain data on the $V_{HH}$ entropy ("$V_{HH}$ Ent.") and $V_{HH}$ variability ("$V_{HH}$ Var.") at each amino acid position for a representative sample of 7732 $V_{HH}$ sequences (including a.o. data kindly provided by David Lutje Hulsing and Prof. Theo Verrips of Utrecht University). The values for the $V_{HH}$ entropy and the $V_{HH}$ variability provide a measure for the variability and degree of conservation of amino acid residues between the 7732 $V_{HH}$ sequences analyzed: low values (i.e. <1, such as <0.5) indicate that an amino acid residue is highly conserved between the $V_{HH}$ sequences (i.e. little variability). For example, the G at position 9 and the W at position 36 have values for the $V_{HH}$ entropy of 0.01 and 0 respectively, indicating that these residues are highly conserved and have little variability (and in case of position 36 is W in all 7732 sequences analysed), whereas for residues that form part of the CDR's generally values of 1.5 or more are found (data not shown). Note that the data represented below support the hypothesis that the amino acid residues at positions 27-30 and maybe even also at positions 93 and 94 already form part of the CDR's (although the invention is not limited to any specific hypothesis or explanation, and as mentioned above, herein the numbering according to Kabat is used). For a general explanation of sequence entropy, sequence variability and the methodology for determining the same, see Oliveira et al., PROTEINS: Structure, Function and Genetics, 52: 544-552 (2003).

TABLE B-4

Non-limiting examples of amino acid residues in FR1 (for the footnotes, see the footnotes to Table B-2)

| Pos. | Human $V_H3$ | Camelid $V_{HH}$'s | $V_{HH}$ Ent. | $V_{HH}$ Var. |
|---|---|---|---|---|
| 1 | E, Q | E, Q, K, D, A, G, R | 0.47 | 5 |
| 2 | V | V, M, A, E, L | 0.04 | 1 |
| 3 | Q | Q, K, P, H, F, R | 0.04 | 1 |
| 4 | L | L, M, Q, P, R, F, V | 0.02 | 1 |
| 5 | V, L | V, Q, M, E, A, L, P, K, R | 0.35 | 3 |
| 6 | E | E, A, Q, D, K, H | 0.21 | 5 |
| 7 | S, T | S, F, L, W, T | 0.05 | 2 |
| 8 | G, R | G, R, E, V | 0.04 | 1 |
| 9 | G | G, R, V, A | 0.01 | 1 |
| 10 | G, V | G, D, R, S, K, E, A, Q, N, T, V | 0.22 | 4 |
| 11 | | Hallmark residue: L, S, V, M, W, F, T, Q, E, A, R, G, K, Y, N, P, I; preferably L | 0.35 | 4 |
| 12 | V, I | V, A, L, M, E, G, T | 0.11 | 2 |
| 13 | Q, K, R | Q, L, R, H, P, E, K, T, S, V, D, G, A, N, M | 0.46 | 3 |
| 14 | P | A, P, T, V, S, D, F, N, I, E, L, R, G, Y, Q, H | 0.92 | 5 |
| 15 | G | G, E | 0 | 1 |
| 16 | G, R | G, D, E, A, S, N, V, R, K, T, P, C, L | 0.47 | 4 |
| 17 | S | S, F, P, Y, T, A, C, R, N | 0.14 | 2 |
| 18 | L | L, V, R, M, P, Q, S, A, T, K, H | 0.06 | 1 |
| 19 | R, K | R, T, K, S, N, G, A, I, L, Q, F, E, V, M | 0.36 | 4 |
| 20 | L | L, F, V, I, P, H, S | 0.18 | 3 |
| 21 | S | S, A, T, P, F, V, H, D, R, L, I, G | 0.13 | 3 |
| 22 | C | C, W | 0 | 1 |
| 23 | A, T | A, V, T, E, S, L, G, I, K, Q, R, D, F, N, P, M | 0.88 | 5 |
| 24 | A | A, D, V, T, H, Y, P, G, S, F, L, I, N, Q, E, R | 0.78 | 9 |
| 25 | S | S, P, T, A, F, L, N, Y, R, H, D, V, I, W, G, K, Q, C | 0.2 | 2 |
| 26 | G | G, E, R, V, T, A, S, K, D, L, I, Q, N, F, Y, M, W, P, H | 0.45 | 6 |
| 27 | F | R, F, S, P, L, G, I, N, T, D, H, V, E, A, Y, K, M, Q, W, C | 1.89 | 12 |
| 28 | T | T, I, S, A, P, F, D, N, V, R, M, L, G, Y, K, E, H, W, Q | 1.29 | 12 |
| 29 | F, V | F, L, S, V, I, A, W, Y, G, D, R, T, P, N, E, M, H, Q, K, C | 1.23 | 11 |
| 30 | S, D, G | S, D, N, G, R, T, A, E, I, Y, K, V, H, L, F, W, M, P, C, Q | 1.55 | 12 |

TABLE B-5

Non-limiting examples of amino acid residues in FR2 (for the footnotes, see the footnotes to Table B-2)

| Pos. | Human V$_H$3 | Amino acid residue(s): Camelid V$_{HH}$'s | V$_{HH}$ Ent. | V$_{HH}$ Var. |
|---|---|---|---|---|
| 36 | W | W | 0 | 1 |
| 37 | | Hallmark residue: F$^{(1)}$, Y, V, L, A, H, S, I, W, C, N, G, D, T, P, preferably F$^{(1)}$ or Y | 1.1 | 7 |
| 38 | R | R, H, C, P, Y, L, V | 0.01 | 1 |
| 39 | Q | Q, E, R, H, L, A, S, K, P, V, T, D | 0.22 | 3 |
| 40 | A | A, V, T, P, G, S, D, I, L, R, N, F, Y, C, E, H | 0.55 | 6 |
| 41 | P, S, T | P, S, A, L, T, Q, R, V, D, G, I, H | 0.18 | 3 |
| 42 | G | G, E, A, R, D, V, W, T, Q, K, L, N, H, M | 0.1 | 2 |
| 43 | K | K, N, Q, E, R, T, L, S, M, D, G, A, V, H, I, F, P | 0.45 | 7 |
| 44 | | Hallmark residue: E$^{(3)}$, Q$^{(3)}$, G$^{(2)}$, D, A, K, R, L, P, S, V, H, T, N, W, M, I; preferably G$^{(2)}$, E$^{(3)}$ or Q$^{(3)}$; most preferably G$^{(2)}$ or Q$^{(3)}$ | 1.11 | 4 |
| 45 | | Hallmark residue: L$^{(2)}$, R$^{(3)}$, P, H, F, G, Q, S, E, T, Y, C, I, D, V; preferably L$^{(2)}$ or R$^{(3)}$ | 0.56 | 3 |
| 46 | E, V | E, D, A, Q, V, M, K, T, G, R, S, N, I, L, F | 0.42 | 4 |
| 47 | | Hallmark residue: F$^{(1)}$, L$^{(1)}$ or W$^{(2)}$ G, I, S, A, V, M, R, Y, E, P, T, C, H, K, Q, N, D; preferably W$^{(2)}$, L$^{(1)}$ or F$^{(1)}$ | 1.64 | 11 |
| 48 | V | V, I, L, A, T, Q, F, M, G, E, R | 0.35 | 5 |
| 49 | S, A, G | A, S, G, T, V, L, C, I, F, P, E, Y, M, D, R | 0.89 | 5 |

TABLE B-6

Non-limiting examples of amino acid residues in FR3 (for the footnotes, see the footnotes to Table B-2)

| Pos. | Human V$_H$3 | Amino acid residue(s): Camelid V$_{HH}$'s | V$_{HH}$ Ent. | V$_{HH}$ Var. |
|---|---|---|---|---|
| 66 | R | R | 0 | 1 |
| 67 | F | F, S, L, V, I, C, A, Y, M, G | 0.1 | 1 |
| 68 | T | T, A, S, I, F, V, P, N, G, R, K, M, D, L, W, Q | 0.34 | 4 |
| 69 | I | I, V, M, T, L, A, F, P, S, G, N | 0.5 | 5 |
| 70 | S | S, T, A, F, P, V, Y, L, D, G, N, H, W, E, C | 0.22 | 4 |
| 71 | R | R, S, K, G, T, I, W, A, N, V, E, L, M, F, D, Q, C | 0.61 | 7 |
| 72 | D, E | D, N, E, G, V, A, H, L, S, T, I, Q, F, P, Y, R | 0.34 | 4 |
| 73 | N, D, G | N, D, S, K, I, Y, G, T, H, R, A, V, F, L, E, M, P, C | 0.65 | 9 |
| 74 | A, S | A, T, V, S, F, G, D, P, N, I, R, L, Y, H, E, Q, K, W, M | 0.8 | 8 |
| 75 | K | K, N, E, R, Q, A, G, T, M, S, L, D, V, W, Y, I | 0.71 | 6 |
| 76 | N, S | N, K, S, R, D, T, H, G, E, A, Y, I, M, Q, L, W, P, F, V | 0.66 | 7 |
| 77 | S, T, I | T, A, M, S, R, I, V, L, P, E, N, K, G, W, Q | 0.72 | 7 |
| 78 | L, A | V, L, A, M, I, G, T, F, W, Q, S, E, N, H | 1.11 | 6 |
| 79 | Y, H | Y, F, D, S, H, N, T, A, L, W, V, C, G, E, I, P, R | 0.68 | 8 |
| 80 | L | L, M, V, P, F | 0.05 | 2 |
| 81 | Q | Q, E, R, H, L, D, T, G, K, P, A, I, S, N, Y, V, M | 0.38 | 4 |
| 82 | M | M, I, L, V, A, T, S, K | 0.12 | 3 |
| 82a | N, G | N, S, D, T, E, H, K, I, A, G, R, Y, L, V, F, Q | 0.77 | 5 |
| 82b | S | S, N, T, G, H, D, R, A, K, I, M, V, F, E, P, Y, C, L | 0.72 | 8 |
| 82c | L | L, V, M, P, A, T, G | 0.08 | 2 |
| 83 | | Hallmark residue: R, K$^{(5)}$, T, E$^{(5)}$, Q, N, S, I, V, G, M, L, A, D, Y, H; preferably K or R; most preferably K | 0.66 | 6 |
| 84 | | Hallmark residue: P$^{(5)}$, S, H, L, A, V, I, T, F, D, R, Y, N, Q, G, E; preferably P | 0.85 | 7 |
| 85 | E, G | E, D, G, A, Q, V, S, N, K, T, R, L | 0.27 | 3 |
| 86 | D | D, E, G, N | 0.02 | 1 |
| 87 | T, M | T, S, A, M, R, P, K, E | 0.15 | 3 |
| 88 | A | A, G, S, D, N, T, P, V | 0.23 | 2 |
| 89 | V, L | V, I, L, E, A, R, T, D, F, M, N, S, K, G, Q, H | 0.71 | 7 |
| 90 | Y | Y, H, F, N | 0 | 1 |
| 91 | Y, H | Y, F, R, S, H, T, I, V, L, N, D, C, Q, W, A, E, M | 0.6 | 7 |
| 92 | C | C, R, P | 0 | 1 |
| 93 | A, K, T | A, N, T, K, G, V, R, Y, S, H, W, L, F, Q, M, I, E, C, D | 1.33 | 10 |
| 94 | K, R, T | A, K, V, T, R, L, G, S, D, Q, I, M, F, Y, N, E, H, P, C, W | 1.55 | 12 |

TABLE B-7

Non-limiting examples of amino acid residues in FR4
(for the footnotes, see the footnotes to Table B-2)

| Pos. | Amino acid residue(s): Human V$_H$3 | Camelid V$_{HH}$'s | V$_{HH}$ Ent. | V$_{HH}$ Var. |
|------|-------------------------------------|--------------------|---------------|---------------|
| 103  | Hallmark residue: W$^{(4)}$, R$^{(6)}$, G, S, K, A, M, Y, L, F, T, N, V, Q, P$^{(6)}$, E, C; preferably W | | 0.54 | 6 |
| 104  | Hallmark residue: G, A, S, T, D, P, N, E, C, L; preferably G | | 0.13 | 3 |
| 105  | Q, R | Q, K, H, R, P, E, L, T, N, S, V, A, M, G | 0.52 | 5 |
| 106  | G | G, R, E | 0 | 1 |
| 107  | T | T, Q, I, A, S, N, R, V, D | 0.24 | 3 |
| 108  | Hallmark residue: Q, L$^{(7)}$, R, P, E, K, S, T, M, A, H; preferably Q or L$^{(7)}$ | | 0.3 | 4 |
| 109  | V | V, I, L | 0 | 1 |
| 110  | T | T, S, N, A, I, F | 0.01 | 1 |
| 111  | V | V, I, A | 0.01 | 1 |
| 112  | S | S, T, P, F, A | 0.01 | 1 |
| 113  | S | S, T, A, L, P, F, E, V | 0.04 | 1 |

Thus, in another preferred, but not limiting aspect, a Nanobody of the invention can be defined as an amino acid sequence with the (general) structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which:
i) one or more of the amino acid residues at positions 11, 37, 44, 45, 47, 83, 84, 103, 104 and 108 according to the Kabat numbering are chosen from the Hallmark residues mentioned in Table B-2;
and in which:
ii) CDR1, CDR2 and CDR3 are as defined herein, and are preferably as defined according to one of the preferred aspects herein, and are more preferably as defined according to one of the more preferred aspects herein.

The above Nanobodies may for example be V$_{HH}$ sequences or may be humanized Nanobodies. When the above Nanobody sequences are V$_{HH}$ sequences, they may be suitably humanized, as further described herein. When the Nanobodies are partially humanized Nanobodies, they may optionally be further suitably humanized, again as described herein.

In particular, a Nanobody of the invention can be an amino acid sequence with the (general) structure

FR1CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which:
i) (preferably) one or more of the amino acid residues at positions 11, 37, 44, 45, 47, 83, 84, 103, 104 and 108 according to the Kabat numbering are chosen from the Hallmark residues mentioned in Table B-2 (it being understood that V$_{HH}$ sequences will contain one or more Hallmark residues; and that partially humanized Nanobodies will usually, and preferably, [still] contain one or more Hallmark residues [although it is also within the scope of the invention to provide—where suitable in accordance with the invention—partially humanized Nanobodies in which all Hallmark residues, but not one or more of the other amino acid residues, have been humanized]; and that in fully humanized Nanobodies, where suitable in accordance with the invention, all amino acid residues at the positions of the Hallmark residues will be amino acid residues that occur in a human V$_H$3 sequence. As will be clear to the skilled person based on the disclosure herein that such V$_{HH}$ sequences, such partially humanized Nanobodies with at least one Hallmark residue, such partially humanized Nanobodies without Hallmark residues and such fully humanized Nanobodies all form aspects of this invention);
and in which:
ii) said amino acid sequence has at least 80% amino acid identity with at least one of the amino acid sequences of SEQ ID NO's: 1 to 22, in which for the purposes of determining the degree of amino acid identity, the amino acid residues that form the CDR sequences (indicated with X in the sequences of SEQ ID NO's: 1 to 22) are disregarded;
and in which:
iii) CDR1, CDR2 and CDR3 are as defined herein, and are preferably as defined according to one of the preferred aspects herein, and are more preferably as defined according to one of the more preferred aspects herein.

The above Nanobodies may for example be V$_{HH}$ sequences or may be humanized Nanobodies. When the above Nanobody sequences are V$_{HH}$ sequences, they may be suitably humanized, as further described herein. When the Nanobodies are partially humanized Nanobodies, they may optionally be further suitably humanized, again as described herein.

TABLE B-8

Representative amino acid sequences for Nanobodies of the KERE, GLEW and P, R, S 103 group.
The CDR's are indicated with XXXXX

| KERE sequence no. 1 | SEQ ID NO: 1 | EVQLVESGGGLVQPGGSLRLSCAASGIPFSXXXXXWFRQAPGKQRDSVAXXXXXRFTISR DNAKNTVYLQMNSLKPEDTAVYRCYFXXXXXWGQGTQVTVSS |
| KERE sequence no. 2 | SEQ ID NO: 2 | QVKLEESGGGLVQAGGSLRLSCVGSGRTFSXXXXXWFRLAPGKEREFVAXXXXXRFTISR DTASNRGYLHMNNLTPEDTAVYYCAAXXXXXWGQGTQVTVSS |
| KERE sequence no. 3 | SEQ ID NO: 3 | AVQLVDSGGGLVQAGDSLKLSCALTGGAFTXXXXXWFRQTPGREREFVAXXXXXRFTIS RDNAKNMVYLRMNSLIPEDAAVYSCAAXXXXXWGQGTLVTVSS |
| KERE sequence no. 4 | SEQ ID NO: 4 | QVQLVESGGGLVEAGGSLRLSCTASESPFRXXXXXWFRQTSGQEREFVAXXXXXRFTISR DDAKNTVWLHGSTLKPEDTAVYYCAAXXXXXWGQGTQVTVSS |
| KERE sequence no. 5 | SEQ ID NO: 5 | AVQLVESGGGLVQGGGSLRLACAASERIFDXXXXXWYRQGPGNERELVAXXXXXRFTIS MDYTKQTVYLHMNSLRPEDTGLYYCKIXXXXXWGQGTQVTVSS |

TABLE B-8-continued

Representative amino acid sequences for Nanobodies of the KERE, GLEW and P, R, S 103 group. The CDR's are indicated with XXXXX

| | | |
|---|---|---|
| KERE sequence no. 6 | SEQ ID NO: 6 | DVKFVESGGGLVQAGGSLRLSCVASGFNFDXXXXXWFRQAPGKEREEVAXXXXXRFTIS SEKDKNSVYLQMNSLKPEDTALYICAGXXXXXWGRGTQVTVSS |
| KERE sequence no. 7 | SEQ ID NO: 7 | QVRLAESGGGLVQSGGSLRLSCVASGSTYTXXXXXWYRQYPGKQRALVAXXXXXRFTIA RDSTKDTFCLQMNNLKPEDTAVYYCYAXXXXXWGQGTQVTVSS |
| KERE sequence no. 8 | SEQ ID NO: 8 | EVQLVESGGGLVQAGGSLRLSCAASGFTSDXXXXXWFRQAPGKPREGVSXXXXXRFTIST DNAKNTVHLLMNRVNAEDTALYYCAVXXXXXWGRGTRVTVSS |
| KERE sequence no. 9 | SEQ ID NO: 9 | QVQLVESGGGLVQPGGSLRLSCQASGDISTXXXXXWYRQVPGKLREFVAXXXXXRFTISG DNAKRAIYLQMNNLKPDDTAVYYCNRXXXXXWGQGTQVTVSP |
| KERE sequence no. 10 | SEQ ID NO: 10 | QVPVVESGGGLVQAGDSLRLFCAVPSFTSTXXXXXWFRQAPGKEREFVAXXXXXRFTISR NATKNTLTLRMDSLKPEDTAVYYCAAXXXXXWGQGTQVTVSS |
| KERE sequence no. 11 | SEQ ID NO: 11 | EVQLVESGGGLVQAGDSLRLFCTVSGGTASXXXXXWFRQAPGEKREFVAXXXXXRFTIA RENAGNMVYLQMNNLKPDDTALYTCAAXXXXXWGRGTQVTVSS |
| KERE sequence no. 12 | SEQ ID NO: 12 | AVQLVESGGDSVQPGDSQTLSCAASGRTNSXXXXXWFRQAPGKERVFLAXXXXXRFTIS RDSAKNMMYLQMNNLKPQDTAVYYCAAXXXXXWGQGTQVTVSS |
| KERE sequence no. 13 | SEQ ID NO: 13 | AVQLVESGGGLVQAGGSLRLSCVVSGLTSSXXXXXWFRQTPWQERDFVAXXXXXRFTIS RDNYKDTVLLEMNFLKPEDTAIYYCAAXXXXXWGQGTQVTVSS |
| KERE sequence no. 14 | SEQ ID NO: 14 | AVQLVESGGGLVQAGASLRLSCATSTRTLDXXXXXWFRQAPGRDREFVAXXXXXRFTVS RDSAENTVALQMNSLKPEDTAVYYCAAXXXXXWGQGTRVTVSS |
| KERE sequence no. 15 | SEQ ID NO: 15 | QVQLVESGGGLVQPGGSLRLSCTVSRLTAHXXXXXWFRQAPGKEREAVSXXXXXRFTISR DYAGNTAFLQMDSLKPEDTGVYYCATXXXXXWGQGTQVTVSS |
| KERE sequence no. 16 | SEQ ID NO: 16 | EVQLVESGGELVQAGGSLKLSCTASGRNFVXXXXXWFRRAPGKEREFVAXXXXXRFTVS RDNGKNTAYLRMNSLKPEDTADYYCAVXXXXXXLGSGTQVTVSS |
| GLEW sequence no. 1 | SEQ ID NO: 17 | AVQLVESGGGLVQPGGSLRLSCAASGFTFSXXXXXWVRQAPGKVLEWVSXXXXXRFTIS RDNAKNTLYLQMNSLKPEDTAVYYCVKXXXXXXGSQGTQVTVSS |
| GLEW sequence no. 2 | SEQ ID NO: 18 | EVQLVESGGGLVQPGGSLRLSCVCVSSGCTXXXXXWVRQAPGKAEEWVSXXXXXRFKIS RDNAKKTLYLQMNSLGPEDTAMYYCQRXXXXXRGQGTQVTVSS |
| GLEW sequence no. 3 | SEQ ID NO: 19 | EVQLVESGGGLALPGGSLTLSCVFSGSTFSXXXXXWVRHTPGKAEEWVSXXXXXRFTISR DNAKNTLYLEMNSLSPEDTAMYYCGRXXXXXRSKGIQVTVSS |
| P, R, S 103 sequence no. 1 | SEQ ID NO: 20 | AVQLVESGGGLVQAGGSLRLSCAASGRTFSXXXXXWFRQAPGKEREFVAXXXXXRFTISR DNAKNTVYLQMNSLKPEDTAVYYCAAXXXXXRGQGTQVTVSS |
| P, R, S 103 sequence no. 2 | SEQ ID NO: 21 | DVQLVESGGDLVQPGGSLRLSCAASGFSFDXXXXXWLRQTPGKGLEWVGXXXXXRFTIS RDNAKNMLYLHLNNLKSEDTAVYYCRRXXXXXLGQGTQVTVSS |
| P, R, S 103 sequence no. 3 | SEQ ID NO: 22 | EVQLVESGGGLVQPGGSLRLSCVCVSSGCTXXXXXWVRQAPGKAEEWVSXXXXXRFKIS RDNAKKTLYLQMNSLGPEDTAMYYCQRXXXXXRGQGTQVTVSS | in particular, a Nanobody of the invention of the KERE group can be an amino acid sequence with the (general) structure

FR1-CDR1-FR2-CDR2-FR3-CDR3-FR4 in which:
i) the amino acid residue at position 45 according to the Kabat numbering is a charged amino acid (as defined herein) or a cysteine residue, and position 44 is preferably an E;

and in which:

ii) FR1 is an amino acid sequence that has at least 80% amino acid identity with at least one of the following amino acid sequences:

TABLE B-9

Representative FW1 sequences for Nanobodies of the KERE-group.

| | | |
|---|---|---|
| KERE FW1 sequence no. 1 | SEQ ID NO: 23 | QVQRVESGGGLVQAGGSLRLSCAASGRTSS |
| KERE FW1 sequence no. 2 | SEQ ID NO: 24 | QVQLVESGGGLVQTGDSLSLSCSASGRTFS |
| KERE FW1 sequence no. 3 | SEQ ID NO: 25 | QVKLEESGGGLVQAGDSLRLSCAATGRAFG |
| KERE FW1 sequence no. 4 | SEQ ID NO: 26 | AVQLVESGGGLVQPGESLGLSCVASGRDFV |

TABLE B-9-continued

Representative FW1 sequences for Nanobodies of the KERE-group.

| | | |
|---|---|---|
| KERE FW1 sequence no. 5 | SEQ ID NO: 27 | EVQLVESGGGLVQAGGSLRLSCEVLGRTAG |
| KERE FW1 sequence no. 6 | SEQ ID NO: 28 | QVQLVESGGGWVQPGGSLRLSCAASETILS |
| KERE FW1 sequence no. 7 | SEQ ID NO: 29 | QVQLVESGGGTVQPGGSLNLSCVASGNTFN |
| KERE FW1 sequence no. 8 | SEQ ID NO: 30 | EVQLVESGGGLAQPGGSLQLSCSAPGFTLD |
| KERE FW1 sequence no. 9 | SEQ ID NO: 31 | AQELEESGGGLVQAGGSLRLSCAASGRTFN | and in which:

iii) FR2 is an amino acid sequence that has at least 80% amino acid identity with at least one of the following amino acid sequences:

TABLE B-10

Representative FW2 sequences for Nanobodies of the KERE-group.

| | | |
|---|---|---|
| KERE FW2 sequence no. 1 | SEQ ID NO: 41 | WFRQAPGKEREFVA |
| KERE FW2 sequence no. 2 | SEQ ID NO: 42 | WFRQTPGREREFVA |
| KERE FW2 sequence no. 3 | SEQ ID NO: 43 | WYRQAPGKQREMVA |
| KERE FW2 sequence no. 4 | SEQ ID NO: 44 | WYRQGPGKQRELVA |
| KERE FW2 sequence no. 5 | SEQ ID NO: 45 | WIRQAPGKEREGVS |
| KERE FW2 sequence no. 6 | SEQ ID NO: 46 | WFREAPGKEREGIS |
| KERE FW2 sequence no. 7 | SEQ ID NO: 47 | WYRQAPGKERDLVA |
| KERE FW2 sequence no. 8 | SEQ ID NO: 48 | WFRQAPGKQREEVS |
| KERE FW2 sequence no. 9 | SEQ ID NO: 49 | WFRQPPGKVREFVG | and in which:

iv) FR3 is an amino acid sequence that has at least 80% amino acid identity with at least one of the following amino acid sequences:

TABLE B-11

Representative FW3 sequences for Nanobodies of the KERE-group.

| | | |
|---|---|---|
| KERE FW3 sequence no. 1 | SEQ ID NO: 50 | RFTISRDNAKNTVYLQMNSLKPEDTAVYRCYF |
| KERE FW3 sequence no. 2 | SEQ ID NO: 51 | RFAISRDNNKNTGYLQMNSLEPEDTAVYYCAA |
| KERE FW3 sequence no. 3 | SEQ ID NO: 52 | RFTVARNNAKNTVNLEMNSLKPEDTAVYYCAA |
| KERE FW3 sequence no. 4 | SEQ ID NO: 53 | RFTISRDIAKNTVDLLMNNLEPEDTAVYYCAA |
| KERE FW3 sequence no. 5 | SEQ ID NO: 54 | RLTISRDNAVDTMYLQMNSLKPEDTAVYYCAA |
| KERE FW3 sequence no. 6 | SEQ ID NO: 55 | RFTISRDNAKNTVYLQMDNVKPEDTAIYYCAA |
| KERE FW3 sequence no. 7 | SEQ ID NO: 56 | RFTISKDSGKNTVYLQMTSLKPEDTAVYYCAT |
| KERE FW3 sequence no. 8 | SEQ ID NO: 57 | RFTISRDSAKNMMYLQMNNLKPQDTAVYYCAA |
| KERE FW3 sequence no. 9 | SEQ ID NO: 58 | RFTISRENDKSTVYLQLNSLKPEDTAVYYCAA |
| KERE FW3 sequence no. 10 | SEQ ID NO: 59 | RFTISRDYAGNTAYLQMNSLKPEDTGVYYCAT | and in which:

v) FR4 is an amino acid sequence that has at least 80% amino acid identity with at least one of the following amino acid sequences:

TABLE B-12

Representative FW4 sequences
for Nanobodies of the KERE-group.

| | | |
|---|---|---|
| KERE FW4 sequence no. 1 | SEQ ID NO: 60 | WGQGTQVTVSS |
| KERE FW4 sequence no. 2 | SEQ ID NO: 61 | WGKGTLVTVSS |
| KERE FW4 sequence no. 3 | SEQ ID NO: 62 | RGQGTRVTVSS |
| KERE FW4 sequence no. 4 | SEQ ID NO: 63 | WGLGTQVTISS | and in which:

vi) CDR1, CDR2 and CDR3 are as defined herein, and are preferably as defined according to one of the preferred aspects herein, and are more preferably as defined according to one of the more preferred aspects herein.

In the above Nanobodies, one or more of the further Hallmark residues are preferably as described herein (for example, when they are $V_{HH}$ sequences or partially humanized Nanobodies).

Also, the above Nanobodies may for example be $V_{HH}$ sequences or may be humanized Nanobodies. When the above Nanobody sequences are $V_{HH}$ sequences, they may be suitably humanized, as further described herein. When the Nanobodies are partially humanized Nanobodies, they may optionally be further suitably humanized, again as described herein.

With regard to framework 1, it will be clear to the skilled person that, when an amino acid sequence as outlined above is generated by expression of a nucleotide sequence, the first four amino acid sequences (i.e. amino acid residues 1-4 according to the Kabat numbering) may often be determined by the primer(s) that have been used to generate said nucleic acid. Thus, for determining the degree of amino acid identity, the first four amino acid residues are preferably disregarded.

Also, with regard to framework 1, and although amino acid positions 27 to 30 are according to the Kabat numbering considered to be part of the framework regions (and not the CDR's), it has been found by analysis of a database of more than 1000 $V_{HH}$ sequences that the positions 27 to 30 have a variability (expressed in terms of $V_{HH}$ entropy and $V_{HH}$ variability—see Tables B-4 to B-7) that is much greater than the variability on positions 1 to 26. Because of this, for determining the degree of amino acid identity, the amino acid residues at positions 27 to 30 are preferably also disregarded.

In view of this, a Nanobody of the KERE class may be an amino acid sequence that is comprised of four framework regions/sequences interrupted by three complementarity determining regions/sequences, in which:

i) the amino acid residue at position 45 according to the Kabat numbering is a charged amino acid (as defined herein) or a cysteine residue, and position 44 is preferably an E;

and in which:

ii) FR1 is an amino acid sequence that, on positions 5 to 26 of the Kabat numbering, has at least 80% amino acid identity with at least one of the following amino acid sequences:

TABLE B-13

Representative FWI sequences (amino acid residues 5 to 26)
for Nanobodies of the KERE-group.

| | | |
|---|---|---|
| KERE FW1 sequence no. 10 | SEQ ID NO: 32 | VESGGGLVQPGGSLRLSCAASG |
| KERE FW1 sequence no. 11 | SEQ ID NO: 33 | VDSGGGLVQAGDSLKLSCALTG |
| KERE FW1 sequence no. 12 | SEQ ID NO: 34 | VDSGGGLVQAGDSLRLSCAASG |
| KERE FW1 sequence no. 13 | SEQ ID NO: 35 | VDSGGGLVEAGGSLRLSCQVSE |
| KERE FW1 sequence no. 14 | SEQ ID NO: 36 | QDSGGGSVQAGGSLKLSCAASG |
| KERE FW1 sequence no. 15 | SEQ ID NO: 37 | VQSGGRLVQAGDSLRLSCAASE |
| KERE FW1 sequence no. 16 | SEQ ID NO: 38 | VESGGTLVQSGDSLKLSCASST |
| KERE FW1 sequence no. 17 | SEQ ID NO: 39 | MESGGDSVQSGGSLTLSCVASG |
| KERE FW1 sequence no. 18 | SEQ ID NO: 40 | QASGGGLVQAGGSLRLSCSASV | and in which:

iii) FR2, FR3 and FR4 are as mentioned herein for FR2, FR3 and FR4 of Nanobodies of the KERE-class;

and in which:

iv) CDR1, CDR2 and CDR3 are as defined herein, and are preferably as defined according to one of the preferred aspects herein, and are more preferably as defined according to one of the more preferred aspects herein.

The above Nanobodies may for example be $V_{HH}$ sequences or may be humanized Nanobodies. When the above Nanobody sequences are $V_{HH}$ sequences, they may be suitably humanized, as further described herein. When the Nanobodies are partially humanized Nanobodies, they may optionally be further suitably humanized, again as described herein.

A Nanobody of the GLEW class may be an amino acid sequence that is comprised of four framework regions/sequences interrupted by three complementarity determining regions/sequences, in which i) preferably, when the Nanobody of the GLEW-class is a non-humanized Nanobody, the amino acid residue in position 108 is Q;

ii) FR1 is an amino acid sequence that has at least 80% amino acid identity with at least one of the following amino acid sequences:

TABLE B-14

Representative FW1 sequences for Nanobodies of the GLEW-group.

| | | | |
|---|---|---|---|
| GLEW FW1 sequence no. 1 | SEQ ID NO: | 64 | QVQLVESGGGLVQPGGSLRLSCAASGFTFS |
| GLEW FW1 sequence no. 2 | SEQ ID NO: | 65 | EVHLVESGGGLVRPGGSLRLSCAAFGFIFK |
| GLEW FW1 sequence no. 3 | SEQ ID NO: | 66 | QVKLEESGGGLAQPGGSLRLSCVASGFTFS |
| GLEW FW1 sequence no. 4 | SEQ ID NO: | 67 | EVQLVESGGGLVQPGGSLRLSCVCVSSGCT |
| GLEW FW1 sequence no. 5 | SEQ ID NO: | 68 | EVQLVESGGGLALPGGSLTLSCVFSGSTFS | and in which:

iii) FR2 is an amino acid sequence that has at least 80% amino acid identity with at least one of the following amino acid sequences:

TABLE B-15

Representative FW2 sequences for Nanobodies of the GLEW-group.

| | | | |
|---|---|---|---|
| GLEW FW2 sequence no. 1 | SEQ ID NO: | 72 | WVRQAPGKVLEWVS |
| GLEW FW2 sequence no. 2 | SEQ ID NO: | 73 | WVRRPPGKGLEWVS |
| GLEW FW2 sequence no. 3 | SEQ ID NO: | 74 | WVRQAPGMGLEWVS |
| GLEW FW2 sequence no. 4 | SEQ ID NO: | 75 | WVRQAPGKEPEWVS |
| GLEW FW2 sequence no. 5 | SEQ ID NO: | 76 | WVRQAPGKDQEWVS |
| GLEW FW2 sequence no. 6 | SEQ ID NO: | 77 | WVRQAPGKAEEWVS |
| GLEW FW2 sequence no. 7 | SEQ ID NO: | 78 | WVRQAPGKGLEWVA |
| GLEW FW2 sequence no. 8 | SEQ ID NO: | 79 | WVRQAPGRATEWVS | and in which:

iv) FR3 is an amino acid sequence that has at least 80% amino acid identity with at least one of the following amino acid sequences:

TABLE B-16

Representative FW3 sequences for Nanobodies of the GLEW-group.

| | | | |
|---|---|---|---|
| GLEW FW3 sequence no. 1 | SEQ ID NO: | 80 | RFTISRDNAKNTLYLQMNSLKPEDTAVYYCVK |
| GLEW FW3 sequence no. 2 | SEQ ID NO: | 81 | RFTISRDNARNTLYLQMDSLIPEDTALYYCAR |
| GLEW FW3 sequence no. 3 | SEQ ID NO: | 82 | RFTSSRDNAKSTLYLQMNDLKPEDTALYYCAR |
| GLEW FW3 sequence no. 4 | SEQ ID NO: | 83 | RFIISRDNAKNTLYLQMNSLGPEDTAMYYCQR |
| GLEW FW3 sequence no. 5 | SEQ ID NO: | 84 | RFTASRDNAKNTLYLQMNSLKSEDTARYYCAR |
| GLEW FW3 sequence no. 6 | SEQ ID NO: | 85 | RFTISRDNAKNTLYLQMDDLQSEDTAMYYCGR | and in which:

v) FR4 is an amino acid sequence that has at least 80% amino acid identity with at least one of the following amino acid sequences:

TABLE B-17

Representative FW4 sequences for Nanobodies of the GLEW-group.

| | | | |
|---|---|---|---|
| GLEW FW4 sequence no. 1 | SEQ ID NO: | 86 | GSQGTQVTVSS |
| GLEW FW4 sequence no. 2 | SEQ ID NO: | 87 | LRGGTQVTVSS |
| GLEW FW4 sequence no. 3 | SEQ ID NO: | 88 | RGQGTLVTVSS |
| GLEW FW4 sequence no. 4 | SEQ ID NO: | 89 | RSRGIQVTVSS |
| GLEW FW4 sequence no. 5 | SEQ ID NO: | 90 | WGKGTQVTVSS |
| GLEW FW4 sequence no. 6 | SEQ ID NO: | 91 | WGQGTQVTVSS | and in which:

vi) CDR1, CDR2 and CDR3 are as defined herein, and are preferably as defined according to one of the preferred aspects herein, and are more preferably as defined according to one of the more preferred aspects herein.

In the above Nanobodies, one or more of the further Hallmark residues are preferably as described herein (for example, when they are $V_{HH}$ sequences or partially humanized Nanobodies).

With regard to framework 1, it will again be clear to the skilled person that, for determining the degree of amino acid identity, the amino acid residues on positions 1 to 4 and 27 to 30 are preferably disregarded.

In view of this, a Nanobody of the GLEW class may be an amino acid sequence that is comprised of four framework regions/sequences interrupted by three complementarity determining regions/sequences, in which:

i) preferably, when the Nanobody of the GLEW-class is a non-humanized Nanobody, the amino acid residue in position 108 is Q;

and in which:

ii) FR1 is an amino acid sequence that, on positions 5 to 26 of the Kabat numbering, has at least 80% amino acid identity with at least one of the following amino acid sequences:

TABLE B-18

| Representative FW1 sequences (amino acid residues 5 to 26) for Nanobodies of the KERE-group. | | |
|---|---|---|
| GLEW FW1 sequence no. 6 | SEQ ID NO: 69 | VESGGGLVQPGGSLRLSCAASG |
| GLEW FW1 sequence no. 7 | SEQ ID NO: 70 | EESGGGLAQPGGSLRLSCVASG |
| GLEW FW1 sequence no. 8 | SEQ ID NO: 71 | VESGGGLALPGGSLTLSCVFSG | and in which:

iii) FR2, FR3 and FR4 are as mentioned herein for FR2, FR3 and FR4 of Nanobodies of the GLEW-class; and in which:

iv) CDR1, CDR2 and CDR3 are as defined herein, and are preferably as defined according to one of the preferred aspects herein, and are more preferably as defined according to one of the more preferred aspects herein.

The above Nanobodies may for example be $V_{HH}$ sequences or may be humanized Nanobodies. When the above Nanobody sequences are $V_{HH}$ sequences, they may be suitably humanized, as further described herein. When the Nanobodies are partially humanized Nanobodies, they may optionally be further suitably humanized, again as described herein. In the above Nanobodies, one or more of the further Hallmark residues are preferably as described herein (for example, when they are $V_{HH}$ sequences or partially humanized Nanobodies).

A Nanobody of the P, R, S 103 class may be an amino acid sequence that is comprised of four framework regions/sequences interrupted by three complementarity determining regions/sequences, in which i) the amino acid residue at position 103 according to the Kabat numbering is different from W;

and in which:

ii) preferably the amino acid residue at position 103 according to the Kabat numbering is P, R or S, and more preferably R;

and in which:

iii) FR1 is an amino acid sequence that has at least 80% amino acid identity with at least one of the following amino acid sequences:

TABLE B-19

| Representative FW1 sequences for Nanobodies of the P, R, S 103-group. | | |
|---|---|---|
| P, R, S 103 FW1 sequence no. 1 | SEQ ID NO: 92 | AVQLVESGGGLVQAGGSLRLSCAASGRTFS |
| P, R, S 103 FW1 sequence no. 2 | SEQ ID NO: 93 | QVQLQESGGGMVQPGGSLRLSCAASGFDFG |
| P, R, S 103 FW1 sequence no. 3 | SEQ ID NO: 94 | EVHLVESGGGLVRPGGSLRLSCAAFGFIFK |
| P, R, S 103 FW1 sequence no. 4 | SEQ ID NO: 95 | QVQLAESGGGLVQPGGSLKLSCAASRTIVS |
| P, R, S 103 FW1 sequence no. 5 | SEQ ID NO: 96 | QEHLVESGGGLVDIGGSLRLSCAASERIFS |
| P, R, S 103 FW1 sequence no. 6 | SEQ ID NO: 97 | QVKLEESGGGLAQPGGSLRLSCVASGFTFS |
| P, R, S 103 FW1 sequence no. 7 | SEQ ID NO: 98 | EVQLVESGGGLVQPGGSLRLSCVCVSSGCT |
| P, R, S 103 FW1 sequence no. 8 | SEQ ID NO: 99 | EVQLVESGGGLALPGGSLTLSCVFSGSTFS | and in which iv) FR2 is an amino acid sequence that has at least 80% amino acid identity with at least one of the following amino acid sequences:

TABLE B-20

| Representative FW2 sequences for Nanobodies of the P, R, S 103-group. | | |
|---|---|---|
| P, R, S 103 FW2 sequence no. 1 | SEQ ID NO: 102 | WFRQAPGKEREFVA |
| P, R, S 103 FW2 sequence no. 2 | SEQ ID NO: 103 | WVRQAPGKVLEWVS |
| P, R, S 103 FW2 sequence no. 3 | SEQ ID NO: 104 | WVRRPPGKGLEWVS |
| P, R, S 103 FW2 sequence no. 4 | SEQ ID NO: 105 | WIRQAPGKEREGVS |
| P, R, S 103 FW2 sequence no. 5 | SEQ ID NO: 106 | WVRQYPGKEPEWVS |
| P, R, S 103 FW2 sequence no. 6 | SEQ ID NO: 107 | WFRQPPGKEHEFVA |
| P, R, S 103 FW2 sequence no. 7 | SEQ ID NO: 108 | WYRQAPGKRTELVA |
| P, R, S 103 FW2 sequence no. 8 | SEQ ID NO: 109 | WLRQAPGQGLEWVS |

TABLE B-20-continued

Representative FW2 sequences
for Nanobodies of the P, R, S 103-group.

P, R, S 103 FW2 sequence no. 9   SEQ ID NO: 110   WLRQTPGKGLEWVG

P, R, S 103 FW2 sequence no. 10  SEQ ID NO: 111   WVRQAPGKAEEFVS and in which:
v) FR3 is an amino acid sequence that has at least 80% amino acid identity with at least one of the following amino acid sequences:

TABLE B-21

Representative FW3 sequences for Nanobodies of the P, R, S 103-group.

P, R, S 103 FW3 sequence no. 1  SEQ ID NO: 112  RFTISRDNAKNTVYLQMNSLKPEDTAVYYCAA P, R, S 103 FW3 sequence no. 2  SEQ ID NO: 113  RFTISRDNARNTLYLQMDSLIPEDTALYYCAR P, R, S 103 FW3 sequence no. 3  SEQ ID NO: 114  RFTISRDNAKNEMYLQMNNLKTEDTGVYWCGA P, R, S 103 FW3 sequence no. 4  SEQ ID NO: 115  RFTISSDSNRNMIYLQMNNLKPEDTAVYYCAA P, R, S 103 FW3 sequence no. 5  SEQ ID NO: 116  RFTISRDNAKNMLYLHLNNLKSEDTAVYYCRR P, R, S 103 FW3 sequence no. 6  SEQ ID NO: 117  RFTISRDNAKKTVYLRLNSLNPEDTAVYSCNL P, R, S 103 FW3 sequence no. 7  SEQ ID NO: 118  RFKISRDNAKKTLYLQMNSLGPEDTAMYYCQR P, R, S 103 FW3 sequence no. 8  SEQ ID NO: 119  RFTVSRDNGKNTAYLRMNSLKPEDTADYYCAV and in which:
vi) FR4 is an amino acid sequence that has at least 80% amino acid identity with at least one of the following amino acid sequences:

TABLE B-22

Representative FW4 sequences for
Nanobodies of the P, R, S 103-group.

| P, R, S 103 FW4 sequence no. 1 | SEQ ID NO: 120 | RGQGTQVTVSS |
| P, R, S 103 FW4 sequence no. 2 | SEQ ID NO: 121 | LRGGTQVTVSS |
| P, R, S 103 FW4 sequence no. 3 | SEQ ID NO: 122 | GNKGTLVTVSS |
| P, R, S 103 FW4 sequence no. 4 | SEQ ID NO: 123 | SSPGTQVTVSS |
| P, R, S 103 FW4 sequence no. 5 | SEQ ID NO: 124 | SSQGTLVTVSS |
| P, R, S 103 FW4 sequence no. 6 | SEQ ID NO: 125 | RSRGIQVTVSS | and in which:
vii) CDR1, CDR2 and CDR3 are as defined herein, and are preferably as defined according to one of the preferred aspects herein, and are more preferably as defined according to one of the more preferred aspects herein.

In the above Nanobodies, one or more of the further Hallmark residues are preferably as described herein (for example, when they are V$_{HH}$ sequences or partially humanized Nanobodies).

With regard to framework 1, it will again be clear to the skilled person that, for determining the degree of amino acid identity, the amino acid residues on positions 1 to 4 and 27 to 30 are preferably disregarded.

In view of this, a Nanobody of the P, R, S 103 class may be an amino acid sequence that is comprised of four framework regions/sequences interrupted by three complementarity determining regions/sequences, in which:
i) the amino acid residue at position 103 according to the Kabat numbering is different from W;
and in which:
ii) preferably the amino acid residue at position 103 according to the Kabat numbering is P, R or 5, and more preferably R;
and in which:
iii) FR1 is an amino acid sequence that, on positions 5 to 26 of the Kabat numbering, has at least 80% amino acid identity with at least one of the following amino acid sequences:

TABLE B-23

Representative FW1 sequences (amino acid residues 5 to 26) for Nanobodies of the P, R, S 103-group.

| P, R, S 103 FW1 sequence no. 9  | SEQ ID NO: 100 | VESGGGLVQAGGSLRLSCAASG |
| P, R, S 103 FW1 sequence no. 10 | SEQ ID NO: 101 | AESGGGLVQPGGSLKLSCAASR | and in which:
iv) FR2, FR3 and FR4 are as mentioned herein for FR2, FR3 and FR4 of Nanobodies of the P, R, S 103 class;
and in which:
v) CDR1, CDR2 and CDR3 are as defined herein, and are preferably as defined according to one of the preferred aspects herein, and are more preferably as defined according to one of the more preferred aspects herein.

The above Nanobodies may for example be V$_{HH}$ sequences or may be humanized Nanobodies. When the above Nanobody sequences are V$_{HH}$ sequences, they may be suitably humanized, as further described herein. When the Nanobodies are partially humanized Nanobodies, they may optionally be further suitably humanized, again as described herein.

In the above Nanobodies, one or more of the further Hallmark residues are preferably as described herein (for example, when they are $V_{HH}$ sequences or partially humanized Nanobodies).

In another preferred, but non-limiting aspect, the invention relates to a Nanobody as described above, in which the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 132-216 (see Table A-3). This degree of amino acid identity can for example be determined by determining the degree of amino acid identity (in a manner described herein) between said Nanobody and one or more of the sequences of SEQ ID NO's: 132-216 (see Table A-1), in which the amino acid residues that form the framework regions are disregarded. Such Nanobodies can be as further described herein.

As already mentioned herein, another preferred but non-limiting aspect of the invention relates to a Nanobody with an amino acid sequence that is chosen from the group consisting of SEQ ID NO's: 132-216 (see Table A-1) or from the group consisting of from amino acid sequences that have more than 80%, preferably more than 90%, more preferably more than 95%, such as 99% or more sequence identity (as defined herein) with at least one of the amino acid sequences of SEQ ID NO's: 132-216 (see Table A-1).

Also, in the above Nanobodies:
i) any amino acid substitution (when it is not a humanizing substitution as defined herein) is preferably, and compared to the corresponding amino acid sequence of SEQ ID NO's: 132-216 (see Table A-3), a conservative amino acid substitution, (as defined herein);
and/or:
ii) its amino acid sequence preferably contains either only amino acid substitutions, or otherwise preferably no more than 5, preferably no more than 3, and more preferably only 1 or 2 amino acid deletions or insertions, compared to the corresponding amino acid sequence of SEQ ID NO's: 132-216 (see Table A-3);
and/or
iii) the CDR's may be CDR's that are derived by means of affinity maturation, for example starting from the CDR's of to the corresponding amino acid sequence of SEQ ID NO's: 132-216 (see Table A-3).

Preferably, the CDR sequences and FR sequences in the Nanobodies of the invention are such that the Nanobodies of the invention (and polypeptides of the invention comprising the same):
bind to IL-6R with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles);
and/or such that they:
bind to IL-6R with a $k_{on}$-rate of between $10^2$ $M^{-1}s^{-1}$ to about $10^7 M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$;
and/or such that they:
bind to IL-6R with a $k_{off}$ rate between 1 $s^{-1}$ ($t_{1/2}$=0.69 s) and $10^{-6}$ $s^{-1}$ (providing a near irreversible complex with a $t_{1/2}$ of multiple days), preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}s^{-1}$ and $10^{-6}$ $s^{-1}$.

Preferably, CDR sequences and FR sequences present in the Nanobodies of the invention are such that the Nanobodies of the invention will bind to IL-6R with an affinity less than 500 nM, preferably less than 200 nM, more preferably less than 10 nM, such as less than 500 µM.

According to one non-limiting aspect of the invention, a Nanobody may be as defined herein, but with the proviso that it has at least "one amino acid difference" (as defined herein) in at least one of the framework regions compared to the corresponding framework region of a naturally occurring human $V_H$ domain, and in particular compared to the corresponding framework region of DP-47. More specifically, according to one non-limiting aspect of the invention, a Nanobody may be as defined herein, but with the proviso that it has at least "one amino acid difference" (as defined herein) at least one of the Hallmark residues (including those at positions 108, 103 and/or 45) compared to the corresponding framework region of a naturally occurring human $V_H$ domain, and in particular compared to the corresponding framework region of DP-47. Usually, a Nanobody will have at least one such amino acid difference with a naturally occurring $V_H$ domain in at least one of FR2 and/or FR4, and in particular at least one of the Hallmark residues in FR2 and/or FR4 (again, including those at positions 108, 103 and/or 45).

Also, a humanized Nanobody of the invention may be as defined herein, but with the proviso that it has at least "one amino acid difference" (as defined herein) in at least one of the framework regions compared to the corresponding framework region of a naturally occurring $V_{HH}$ domain. More specifically, according to one non-limiting aspect of the invention, a humanized Nanobody may be as defined herein, but with the proviso that it has at least "one amino acid difference" (as defined herein) at least one of the Hallmark residues (including those at positions 108, 103 and/or 45) compared to the corresponding framework region of a naturally occurring $V_{HH}$ domain. Usually, a humanized Nanobody will have at least one such amino acid difference with a naturally occurring $V_{HH}$ domain in at least one of FR2 and/or FR4, and in particular at least one of the Hallmark residues in FR2 and/or FR4 (again, including those at positions 108, 103 and/or 45).

As will be clear from the disclosure herein, it is also within the scope of the invention to use natural or synthetic analogs, mutants, variants, alleles, homologs and orthologs (herein collectively referred to as "analogs") of the Nanobodies of the invention as defined herein, and in particular analogs of the Nanobodies of SEQ ID NO's: 132-216 (see Table A-3). Thus, according to one aspect of the invention, the term "Nanobody of the invention" in its broadest sense also covers such analogs.

Generally, in such analogs, one or more amino acid residues may have been replaced, deleted and/or added, compared to the Nanobodies of the invention as defined herein. Such substitutions, insertions or deletions may be made in one or more of the framework regions and/or in one or more of the CDR's. When such substitutions, insertions or deletions are made in one or more of the framework regions, they may be made at one or more of the Hallmark residues and/or at one or more of the other positions in the framework residues, although substitutions, insertions or deletions at the Hallmark residues are generally less preferred (unless these are suitable humanizing substitutions as described herein).

By means of non-limiting examples, a substitution may for example be a conservative substitution (as described herein) and/or an amino acid residue may be replaced by another amino acid residue that naturally occurs at the same position in another $V_{HH}$ domain (see Tables B-4 to B-7 for some non-limiting examples of such substitutions), although the invention is generally not limited thereto. Thus, any one or more substitutions, deletions or insertions, or any combination thereof, that either improve the properties of the Nanobody of the invention or that at least do not detract too much from the desired properties or from the balance or combination of desired properties of the Nanobody of the invention (i.e. to the extent that the Nanobody is no longer suited for its intended use) are included within the scope of the invention. A skilled person will generally be able to determine and select suitable substitutions, deletions or insertions, or suitable combinations of thereof, based on the disclosure herein and optionally after a limited degree of routine experimentation, which may for example involve introducing a limited number of possible substitutions and determining their influence on the properties of the Nanobodies thus obtained.

For example, and depending on the host organism used to express the Nanobody or polypeptide of the invention, such deletions and/or substitutions may be designed in such a way that one or more sites for post-translational modification (such as one or more glycosylation sites) are removed, as will be within the ability of the person skilled in the art. Alternatively, substitutions or insertions may be designed so as to introduce one or more sites for attachment of functional groups (as described herein), for example to allow site-specific pegylation (again as described herein).

As can be seen from the data on the $V_{HH}$ entropy and $V_{HH}$ variability given in Tables 8-4 to B-7 above, some amino acid residues in the framework regions are more conserved than others. Generally, although the invention in its broadest sense is not limited thereto, any substitutions, deletions or insertions are preferably made at positions that are less conserved. Also, generally, amino acid substitutions are preferred over amino acid deletions or insertions.

The analogs are preferably such that they can bind to IL-6R with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein for the Nanobodies of the invention.

The analogs are preferably also such that they retain the favourable properties the Nanobodies, as described herein.

Also, according to one preferred aspect, the analogs have a degree of sequence identity of at least 70%, preferably at least 80%, more preferably at least 90%, such as at least 95% or 99% or more; and/or preferably have at most 20, preferably at most 10, even more preferably at most 5, such as 4, 3, 2 or only 1 amino acid difference (as defined herein), with one of the Nanobodies of SEQ ID NOs: 132-216 (see Table A-3).

Also, the framework sequences and CDR's of the analogs are preferably such that they are in accordance with the preferred aspects defined herein. More generally, as described herein, the analogs will have (a) a Q at position 108; and/or (b) a charged amino acid or a cysteine residue at position 45 and preferably an E at position 44, and more preferably E at position 44 and R at position 45; and/or (c) P, R or S at position 103.

One preferred class of analogs of the Nanobodies of the invention comprise Nanobodies that have been humanized (i.e. compared to the sequence of a naturally occurring Nanobody of the invention). As mentioned in the background art cited herein, such humanization generally involves replacing one or more amino acid residues in the sequence of a naturally occurring $V_{HH}$ with the amino acid residues that occur at the same position in a human $V_H$ domain, such as a human $V_H3$ domain. Examples of possible humanizing substitutions or combinations of humanizing substitutions will be clear to the skilled person, for example from the Tables herein, from the possible humanizing substitutions mentioned in the background art cited herein, and/or from a comparison between the sequence of a Nanobody and the sequence of a naturally occurring human $V_H$ domain.

The humanizing substitutions should be chosen such that the resulting humanized Nanobodies still retain the favourable properties of Nanobodies as defined herein, and more preferably such that they are as described for analogs in the preceding paragraphs. A skilled person will generally be able to determine and select suitable humanizing substitutions or suitable combinations of humanizing substitutions, based on the disclosure herein and optionally after a limited degree of routine experimentation, which may for example involve introducing a limited number of possible humanizing substitutions and determining their influence on the properties of the Nanobodies thus obtained.

Generally, as a result of humanization, the Nanobodies of the invention may become more "human-like", while still retaining the favorable properties of the Nanobodies of the invention as described herein. As a result, such humanized Nanobodies may have several advantages, such as a reduced immunogenicity, compared to the corresponding naturally occurring $V_{HH}$ domains. Again, based on the disclosure herein and optionally after a limited degree of routine experimentation, the skilled person will be able to select humanizing substitutions or suitable combinations of humanizing substitutions which optimize or achieve a desired or suitable balance between the favourable properties provided by the humanizing substitutions on the one hand and the favourable properties of naturally occurring $V_{HH}$ domains on the other hand.

The Nanobodies of the invention may be suitably humanized at any framework residue(s), such as at one or more Hallmark residues (as defined herein) or at one or more other framework residues (i.e. non-Hallmark residues) or any suitable combination thereof. One preferred humanizing substitution for Nanobodies of the "P, R, S-103 group" or the "KERE group" is 0108 into L108. Nanobodies of the "GLEW class" may also be humanized by a 0108 into L108 substitution, provided at least one of the other Hallmark residues contains a camelid (camelizing) substitution (as defined herein). For example, as mentioned above, one particularly preferred class of humanized Nanobodies has GLEW or a GLEW-like sequence at positions 44-47; P, R or S (and in particular R) at position 103, and an L at position 108.

The humanized and other analogs, and nucleic acid sequences encoding the same, can be provided in any manner known per se, for example using one or more of the techniques mentioned on pages 103 and 104 of WO 08/020, 079.

As mentioned there, it will be also be clear to the skilled person that the Nanobodies of the invention (including their analogs) can be designed and/or prepared starting from human $V_H$ sequences (i.e. amino acid sequences or the corresponding nucleotide sequences), such as for example from human $V_H3$ sequences such as DP-47, DP-51 or DP-29, i.e. by introducing one or more camelizing substitutions (i.e. changing one or more amino acid residues in the amino acid sequence of said human $V_H$ domain into the amino acid residues that occur at the corresponding position in a $V_{HH}$ domain), so as to provide the sequence of a Nanobody of the invention and/or so as to confer the favourable properties of a Nanobody to the sequence thus obtained. Again, this can generally be performed using the various methods and techniques referred to in the previous paragraph, using an amino acid sequence and/or nucleotide sequence for a human $V_H$ domain as a starting point.

Some preferred, but non-limiting camelizing substitutions can be derived from Tables B-4-B-7. It will also be clear that camelizing substitutions at one or more of the Hallmark residues will generally have a greater influence on the desired properties than substitutions at one or more of the other amino acid positions, although both and any suitable combination thereof are included within the scope of the invention. For example, it is possible to introduce one or more camelizing substitutions that already confer at least some the desired properties, and then to introduce further camelizing substitutions that either further improve said properties and/or confer additional favourable properties. Again, the skilled person will generally be able to determine and select suitable camelizing substitutions or suitable combinations of camelizing substitutions, based on the disclosure herein and optionally after a limited degree of routine experimentation, which may for example involve introducing a limited number of possible camelizing substitutions and determining whether the favourable properties of Nanobodies are obtained or improved (i.e. compared to the original $V_H$ domain).

Generally, however, such camelizing substitutions are preferably such that the resulting an amino acid sequence at least contains (a) a Q at position 108; and/or (b) a charged amino acid or a cysteine residue at position 45 and preferably also an E at position 44, and more preferably E at position 44 and Rat position 45; and/or (c) P, R or S at position 103; and optionally one or more further camelizing substitutions. More preferably, the camelizing substitutions are such that they result in a Nanobody of the invention and/or in an analog thereof (as defined herein), such as in a humanized analog and/or preferably in an analog that is as defined in the preceding paragraphs.

Nanobodies can also be derived from $V_H$ domains by the incorporation of substitutions that are rare in nature, but nonetheless, structurally compatible with the VH domain fold. For example, but without being limiting, these substitutions may include on or more of the following: Gly at position 35, Ser, Val or Thr at position 37, Ser, Thr, Arg, Lys, H is, Asp or Glu at position 39, Glu or H is at position 45, Trp, Leu, Val, Ala, Thr, or Glu at position 47, S or R at position 50. (Barthelemy et al. J Bid Chem. 2008 Feb. 8; 283(6):3639-54. Epub 2007 Nov. 28)

As will also be clear from the disclosure herein, it is also within the scope of the invention to use parts or fragments, or combinations of two or more parts or fragments, of the Nanobodies of the invention as defined herein, and in particular parts or fragments of the Nanobodies of SEQ ID NO's: 132-216 (see Table A-3). Thus, according to one aspect of the invention, the term "Nanobody of the invention" in its broadest sense also covers such parts or fragments.

Generally, such parts or fragments of the Nanobodies of the invention (including analogs thereof) have amino acid sequences in which, compared to the amino acid sequence of the corresponding full length Nanobody of the invention (or analog thereof), one or more of the amino acid residues at the N-terminal end, one or more amino acid residues at the C-terminal end, one or more contiguous internal amino acid residues, or any combination thereof, have been deleted and/or removed.

The parts or fragments are preferably such that they can bind to IL-6R with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein for the Nanobodies of the invention.

Any part or fragment is preferably such that it comprises at least 10 contiguous amino acid residues, preferably at least 20 contiguous amino acid residues, more preferably at least 30 contiguous amino acid residues, such as at least 40 contiguous amino acid residues, of the amino acid sequence of the corresponding full length Nanobody of the invention.

Also, any part or fragment is such preferably that it comprises at least one of CDR1, CDR2 and/or CDR3 or at least part thereof (and in particular at least CDR3 or at least part thereof). More preferably, any part or fragment is such that it comprises at least one of the CDR's (and preferably at least CDR3 or part thereof) and at least one other CDR (i.e. CDR1 or CDR2) or at least part thereof, preferably connected by suitable framework sequence(s) or at least part thereof. More preferably, any part or fragment is such that it comprises at least one of the CDR's (and preferably at least CDR3 or part thereof) and at least part of the two remaining CDR's, again preferably connected by suitable framework sequence(s) or at least part thereof.

According to another particularly preferred, but non-limiting aspect, such a part or fragment comprises at least CDR3, such as FR3, CDR3 and FR4 of the corresponding full length Nanobody of the invention, i.e. as for example described in the International application WO 03/050531 (Lasters et al.).

As already mentioned above, it is also possible to combine two or more of such parts or fragments (i.e. from the same or different Nanobodies of the invention), i.e. to provide an analog (as defined herein) and/or to provide further parts or fragments (as defined herein) of a Nanobody of the invention. It is for example also possible to combine one or more parts or fragments of a Nanobody of the invention with one or more parts or fragments of a human $V_H$ domain.

According to one preferred aspect, the parts or fragments have a degree of sequence identity of at least 50%, preferably at least 60%, more preferably at least 70%, even more preferably at least 80%, such as at least 90%, 95% or 99% or more with one of the Nanobodies of SEQ ID NOs 132-216 (see Table A-3).

The parts and fragments, and nucleic acid sequences encoding the same, can be provided and optionally combined in any manner known per se. For example, such parts or fragments can be obtained by inserting a stop codon in a nucleic acid that encodes a full-sized Nanobody of the invention, and then expressing the nucleic acid thus obtained in a manner known per se (e.g. as described herein). Alternatively, nucleic acids encoding such parts or fragments can be obtained by suitably restricting a nucleic acid that encodes a full-sized Nanobody of the invention or by synthesizing such a nucleic acid in a manner known per se. Parts or fragments may also be provided using techniques for peptide synthesis known per se.

The invention in its broadest sense also comprises derivatives of the biparatopic (or multiparatopic polypeptides and/or Nanobodies of the invention. Such derivatives can generally be obtained by modification, and in particular by chemical and/or biological (e.g. enzymatical) modification, of the biparatopic (or multiparatopic) polypeptides and/or Nanobodies of the invention and/or of one or more of the amino acid residues that form the biparatopic (or multiparatopic) polypeptides and/or Nanobodies of the invention.

Examples of such modifications, as well as examples of amino acid residues within the biparatopic (or multiparatopic) polypeptide and/or Nanobody sequence that can be modified in such a manner (i.e. either on the protein backbone but preferably on a side chain), methods and techniques that can be used to introduce such modifications and the potential uses and advantages of such modifications will be clear to the skilled person.

For example, such a modification may involve the introduction (e.g. by covalent linking or in an other suitable manner) of one or more functional groups, residues or moieties into or onto the biparatopic (or multiparatopic) polypeptide and/or Nanobody of the invention, and in particular of one or more functional groups, residues or moieties that confer one or more desired properties or functionalities to the biparatopic (or multiparatopic) polypeptide and/or Nanobody of the invention. Example of such functional groups will be clear to the skilled person.

For example, such modification may comprise the introduction (e.g. by covalent binding or in any other suitable manner) of one or more functional groups that increase the half-life, the solubility and/or the absorption of the biparatopic (or multiparatopic) polypeptide and/or Nanobody of the invention, that reduce the immunogenicity and/or the toxicity of the biparatopic (or multiparatopic polypeptide and/or Nanobody of the invention, that eliminate or attenuate any undesirable side effects of the biparatopic (or multiparatopic) polypeptide and/or Nanobody of the invention, and/or that confer other advantageous properties to and/or reduce the undesired properties of the biparatopic (or multiparatopic) polypeptides and/or Nanobodies and/or polypeptides of the invention; or any combination of two or more of the foregoing. Examples of such functional groups and of techniques for introducing them will be clear to the skilled person, and can generally comprise all functional groups and techniques mentioned in the general background art cited hereinabove as well as the functional groups and techniques known per se for the modification of pharmaceutical proteins, and in particular for the modification of antibodies or antibody fragments (including ScFv's and single domain antibodies), for which reference is for example made to Remington's Pharmaceutical Sciences, 16th ed., Mack Publishing Co., Easton, Pa. (1980). Such functional groups may for example be linked directly (for example covalently) to a biparatopic (or multiparatopic) polypeptide and/or Nanobody of the invention, or optionally via a suitable linker or spacer, as will again be clear to the skilled person.

One of the most widely used techniques for increasing the half-life and/or reducing the immunogenicity of pharmaceutical proteins comprises attachment of a suitable pharmacologically acceptable polymer, such as polyethyleneglycol) (PEG) or derivatives thereof (such as methoxypoly(ethyleneglycol) or mPEG). Generally, any suitable form of pegylation can be used, such as the pegylation used in the art for antibodies and antibody fragments (including but not limited to (single) domain antibodies and ScFv's); reference is made to for example Chapman, Nat. Biotechnol., 54, 531-545 (2002); by Veronese and Harris, Adv. Drug Deliv. Rev. 54, 453-456 (2003), by Harris and Chess, Nat. Rev. Drug. Discov., 2, (2003) and in WO 04/060965. Various reagents for pegylation of proteins are also commercially available, for example from Nektar Therapeutics, USA.

Preferably, site-directed pegylation is used, in particular via a cysteine-residue (see for example Yang et al., Protein Engineering, 16, 10, 761-770 (2003). For example, for this purpose, PEG may be attached to a cysteine residue that naturally occurs in a biparatopic (or multiparatopic) polypeptide and/or Nanobody of the invention, a biparatopic (or multiparatopic) polypeptide and/or Nanobody of the invention may be modified so as to suitably introduce one or more cysteine residues for attachment of PEG, or an amino acid sequence comprising one or more cysteine residues for attachment of PEG may be fused to the N- and/or C-terminus of a biparatopic (or multiparatopic polypeptide and/or Nanobody of the invention, all using techniques of protein engineering known per se to the skilled person.

Preferably, for the biparatopic (or multiparatopic) polypeptide, Nanobodies and proteins of the invention, a PEG is used with a molecular weight of more than 5000, such as more than 10,000 and less than 200,000, such as less than 100,000; for example in the range of 20,000-80,000.

Another, usually less preferred modification comprises N-linked or O-linked glycosylation, usually as part of co-translational and/or post-translational modification, depending on the host cell used for expressing the biparatopic (or multiparatopic) polypeptide and/or Nanobody of the invention.

Yet another modification may comprise the introduction of one or more detectable labels or other signal-generating groups or moieties, depending on the intended use of the labelled Nanobody. Suitable labels and techniques for attaching, using and detecting them will be clear to the skilled person, and for example include, but are not limited to, the fluorescent labels, phosphorescent labels, chemiluminescent labels, bioluminescent labels, radio-isotopes, metals, metal chelates, metallic cations, chromophores and enzymes, such as those mentioned on page 109 of WO 08/020,079. Other suitable labels will be clear to the skilled person, and for example include moieties that can be detected using NMR or ESR spectroscopy.

Such labelled biparatopic (or multiparatopic) polypeptides and/or Nanobodies of the invention may for example be used for in vitro, in vivo or in situ assays (including immunoassays known per se such as ELISA, RIA, EIA and other "sandwich assays", etc.) as well as in vivo diagnostic and imaging purposes, depending on the choice of the specific label.

As will be clear to the skilled person, another modification may involve the introduction of a chelating group, for example to chelate one of the metals or metallic cations referred to above. Suitable chelating groups for example include, without limitation, diethyl-enetriaminepentaacetic acid (DTPA) or ethylenediaminetetraacetic acid (EDTA).

Yet another modification may comprise the introduction of a functional group that is one part of a specific binding pair, such as the biotin-(strept)avidin binding pair. Such a functional group may be used to link the biparatopic (or multiparatopic) polypeptides and/or Nanobody of the invention to another protein, polypeptide or chemical compound that is bound to the other half of the binding pair, i.e. through formation of the binding pair. For example, a biparatopic (or multiparatopic) polypeptides and/or Nanobody of the invention may be conjugated to biotin, and linked to another protein, polypeptide, compound or carrier conjugated to avidin or streptavidin. For example, such a conjugated biparatopic (or multiparatopic) polypeptides and/or Nanobody may be used as a reporter, for example in a diagnostic system where a detectable signal-producing agent is conjugated to avidin or streptavidin. Such binding pairs may for example also be used to bind the biparatopic (or multiparatopic) polypeptides and/or Nanobody of the invention to a carrier, including carriers suitable for pharmaceutical purposes. One non-limiting example are the liposomal formulations described by Cao and Suresh, Journal of Drug Targetting, 8, 4, 257 (2000). Such binding pairs may also be used to link a therapeutically active agent to the biparatopic (or multiparatopic) polypeptides and/or Nanobody of the invention.

Other potential chemical and enzymatical modifications will be clear to the skilled person. Such modifications may also be introduced for research purposes (e.g. to study function-activity relationships). Reference is for example made to Lundblad and Bradshaw, Biotechnol. Appf. Biochem., 26, 143-151 (1997).

Preferably, the derivatives are such that they bind to IL-6R with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein for the Nanobodies of the invention.

As mentioned above, the invention also relates to proteins or polypeptides that essentially consist of or comprise at least one biparatopic (or multiparatopic) polypeptide and/or Nanobody of the invention. By "essentially consist of" is meant that the amino acid sequence of the polypeptide of the invention either is exactly the same as the amino acid sequence of a biparatopic (or multiparatopic) polypeptide and/or Nanobody of the invention or corresponds to the amino acid sequence of a biparatopic (or multiparatopic) polypeptide and/or Nanobody of the invention which has a limited number of amino acid residues, such as 1-20 amino acid residues, for example 1-10 amino acid residues and preferably 1-6 amino acid residues, such as 1, 2, 3, 4, 5 or 6 amino acid residues, added at the amino terminal end, at the carboxy terminal end, or at both the amino terminal end and the carboxy terminal end of the amino acid sequence of the biparatopic (or multiparatopic) polypeptide and/or Nanobody.

Said amino acid residues may or may not change, alter or otherwise influence the (biological) properties of the biparatopic (or multiparatopic) polypeptide and/or Nanobody and may or may not add further functionality to the biparatopic (or multiparatopic) polypeptide and/or Nanobody. For example, such amino acid residues:

can comprise an N-terminal Met residue, for example as result of expression in a heterologous host cell or host organism.

may form a signal sequence or leader sequence that directs secretion of the biparatopic (or multiparatopic) polypeptide and/or Nanobody from a host cell upon synthesis. Suitable secretory leader peptides will be clear to the skilled person, and may be as further described herein. Usually, such a leader sequence will be linked to the N-terminus of the biparatopic (or multiparatopic) polypeptide and/or Nanobody, although the invention in its broadest sense is not limited thereto;

may form a sequence or signal that allows the biparatopic (or multiparatopic) polypeptide and/or Nanobody to be directed towards and/or to penetrate or enter into specific organs, tissues, cells, or parts or compartments of cells, and/or that allows the biparatopic (or multiparatopic) polypeptide and/or Nanobody to penetrate or cross a biological barrier such as a cell membrane, a cell layer such as a layer of epithelial cells, a tumor including solid tumors, or the blood-brain-barrier. Examples of such amino acid sequences will be clear to the skilled person and include those mentioned in paragraph c) on page 112 of WO 08/020,079.

may form a "tag", for example an amino acid sequence or residue that allows or facilitates the purification of the biparatopic (or multiparatopic) polypeptide and/or Nanobody, for example using affinity techniques directed against said sequence or residue. Thereafter, said sequence or residue may be removed (e.g. by chemical or enzymatical cleavage) to provide the biparatopic (or multiparatopic) polypeptide and/or Nanobody sequence (for this purpose, the tag may optionally be linked to the biparatopic (or multiparatopic) polypeptide and/or Nanobody sequence via a cleavable linker sequence or contain a cleavable motif). Some preferred, but non-limiting examples of such residues are multiple histidine residues, glutatione residues and a myc-tag (see for example SEQ ID NO:31 of WO 06/12282).

may be one or more amino acid residues that have been functionalized and/or that can serve as a site for attachment of functional groups. Suitable amino acid residues and functional groups will be clear to the skilled person and include, but are not limited to, the amino acid residues and functional groups mentioned herein for the derivatives of the biparatopic (or multiparatopic) polypeptides and/or Nanobodies of the invention.

According to another aspect, a polypeptide of the invention comprises a biparatopic (or multiparatopic) polypeptide and/or Nanobody of the invention, which is fused at its amino terminal end, at its carboxy terminal end, or both at its amino terminal end and at its carboxy terminal end to at least one further amino acid sequence, i.e. so as to provide a fusion protein comprising said Nanobody of the invention and the one or more further amino acid sequences. Such a fusion will also be referred to herein as a "Nanobody fusion".

The one or more further amino acid sequence may be any suitable and/or desired amino acid sequences. The further amino acid sequences may or may not change, alter or otherwise influence the (biological) properties of the biparatopic (or multiparatopic) polypeptide and/or Nanobody, and may or may not add further functionality to the biparatopic (or multiparatopic) polypeptide and/or Nanobody or the polypeptide of the invention. Preferably, the further amino acid sequence is such that it confers one or more desired properties or functionalities to the biparatopic (or multiparatopic) polypeptide, Nanobody or the polypeptide of the invention.

For example, the further amino acid sequence may also provide a second binding site, which binding site may be directed against any desired protein, polypeptide, antigen, antigenic determinant or epitope (including but not limited to the same protein, polypeptide, antigen, antigenic determinant or epitope against which the biparatopic (or multiparatopic) polypeptide and/or Nanobody of the invention is directed, or a different protein, polypeptide, antigen, antigenic determinant or epitope).

Example of such amino acid sequences will be clear to the skilled person, and may generally comprise all amino acid sequences that are used in peptide fusions based on conventional antibodies and fragments thereof (including but not limited to ScFv's and single domain antibodies). Reference is for example made to the review by Holliger and Hudson, Nature Biotechnology, 23, 9, 1126-1136 (2005).

For example, such an amino acid sequence may be an amino acid sequence that increases the half-life, the solubility, or the absorption, reduces the immunogenicity or the toxicity, eliminates or attenuates undesirable side effects, and/or confers other advantageous properties to and/or reduces the undesired properties of the polypeptides of the invention, compared to the biparatopic (or multiparatopic) polypeptide and/or Nanobody of the invention per se. Some non-limiting examples of such amino acid sequences are serum proteins, such as human serum albumin (see for example WO 00/27435) or haptenic molecules (for example haptens that are recognized by circulating antibodies, see for example WO 98/22141).

In particular, it has been described in the art that linking fragments of immunoglobulins (such as $V_H$ domains) to serum albumin or to fragments thereof can be used to increase the half-life. Reference is for made to WO 00/27435 and WO 01/077137). According to the invention, the biparatopic (or multiparatopic) polypeptide and/or Nanobody of the invention is preferably either directly linked to serum albumin (or to a suitable fragment thereof) or via a suitable linker, and in particular via a suitable peptide linked so that the polypeptide of the invention can be expressed as a genetic fusion (protein). According to one specific aspect, the biparatopic (or multiparatopic) polypeptide and/or Nanobody of the invention may be linked to a fragment of serum albumin that at least comprises the domain III of serum albumin or part thereof. Reference is for example made to WO 07/112,940 of Ablynx N.V.

Alternatively, the further amino acid sequence may provide a second binding site or binding unit that is directed against a serum protein (such as, for example, human serum albumin or another serum protein such as IgG), so as to provide increased half-life in serum. Such amino acid sequences for example include the Nanobodies described below, as well as the small peptides and binding proteins described in WO 91/01743, VVO 01/45746 and WO 02/076489 and the dAb's described in WO 03/002609 and WO 04/003019. Reference is also made to Harmsen et al., Vaccine, 23 (41); 4926-42, 2005, as well as to EP 0 368 684, as well as to WO 08/028,977, WO 08/043,821, WO 08/043, 822 by Ablynx N.V. and WO 08/068,280.

Such amino acid sequences may in particular be directed against serum albumin (and more in particular human serum albumin) and/or against IgG (and more in particular human IgG). For example, such amino acid sequences may be amino acid sequences that are directed against (human) serum albumin and amino acid sequences that can bind to amino acid residues on (human) serum albumin that are not involved in binding of serum albumin to FcRn (see for example WO 06/0122787) and/or amino acid sequences that are capable of binding to amino acid residues on serum albumin that do not form part of domain III of serum albumin (see again for example WO 06/0122787); amino acid sequences that have or can provide an increased half-life (see for example WO 08/028,977 by Ablynx N.V.); amino acid sequences against human serum albumin that are cross-reactive with serum albumin from at least one species of mammal, and in particular with at least one species of primate (such as, without limitation, monkeys from the genus Macaca (such as, and in particular, cynomologus monkeys (*Macaca fascicularis*) and/or rhesus monkeys (*Macaca mulatto*)) and baboon (*Paolo ursinus*), reference is again made to WO 08/028,977; amino acid sequences that can bind to serum albumin in a pH independent manner (see for example WO 08/043,821 by Ablynx N.V. entitled "Amino acid sequences that bind to serum proteins in a manner that is essentially independent of the pH, compounds comprising the same, and uses thereof") and/or amino acid sequences that are conditional binders (see for example WO 08/043,822 by Ablynx N.V. entitled "Amino acid sequences that bind to a desired molecule in a conditional manner").

According to another aspect, the one or more further amino acid sequence may comprise one or more parts, fragments or domains of conventional 4-chain antibodies (and in particular human antibodies) and/or of heavy chain antibodies. For example, although usually less preferred, a biparatopic (or multiparatopic) polypeptide and/or Nanobody of the invention may be linked to a conventional (preferably human) $V_H$ or $V_L$ domain or to a natural or synthetic analog of a $V_H$ or $V_L$ domain, again optionally via a linker sequence (including but not limited to other (single) domain antibodies, such as the dAb's described by Ward et al.).

The at least one biparatopic (or multiparatopic) polypeptide and/or Nanobody may also be linked to one or more (preferably human) $C_H1$, $C_H2$ and/or $C_H3$ domains, optionally via a linker sequence. For instance, a biparatopic (or multiparatopic) polypeptide and/or Nanobody linked to a suitable $C_H1$ domain could for example be used—together with suitable light chains—to generate antibody fragments/structures analogous to conventional Fab fragments or F(ab')$_2$ fragments, but in which one or (in case of an F(ab')$_2$ fragment) one or both of the conventional $V_H$ domains have been replaced by a biparatopic (or multiparatopic) polypeptide and/or Nanobody of the invention. Also, two biparatopic (or multiparatopic) polypeptide and/or Nanobodies could be linked to a $C_H3$ domain (optionally via a linker) to provide a construct with increased half-life in vivo.

According to one specific aspect of a polypeptide of the invention, one or more biparatopic (or multiparatopic) polypeptides and/or Nanobodies of the invention may be linked (optionally via a suitable linker or hinge region) to one or more constant domains (for example, 2 or 3 constant domains that can be used as part of/to form an Fc portion), to an Fc portion and/or to one or more antibody parts, fragments or domains that confer one or more effector functions to the polypeptide of the invention and/or may confer the ability to bind to one or more Fc receptors. For example, for this purpose, and without being limited thereto, the one or more further amino acid sequences may comprise one or more $C_H2$ and/or $C_H3$ domains of an antibody, such as from a heavy chain antibody (as described herein) and more preferably from a conventional human 4-chain antibody; and/or may form (part of) and Fc region, for example from IgG (e.g. from IgG1, IgG2, IgG3 or IgG4), from IgE or from another human Ig such as IgA, IgD or 1 μM. For example, WO 94/04678 describes heavy chain antibodies comprising a Camelid $V_{HH}$ domain or a humanized derivative thereof (i.e. a Nanobody), in which the Camelidae $C_H2$ and/or $C_H3$ domain have been replaced by human $C_H2$ and $C_H3$ domains, so as to provide an immunoglobulin that consists of 2 heavy chains each comprising a Nanobody and human $C_H2$ and $C_H3$ domains (but no $C_H1$ domain), which immunoglobulin has the effector function provided by the $C_H2$ and $C_H3$ domains and which immunoglobulin can function without the presence of any light chains. Other amino acid sequences that can be suitably linked to the biparatopic (or multiparatopic) polypeptides and/or Nanobodies of the invention so as to provide an effector function will be clear to the skilled person, and may be chosen on the basis of the desired effector function(s). Reference is for example made to WO 04/058820, WO 99/42077, WO 02/056910 and WO 05/017148, as well as the review by Holliger and Hudson, supra; and to WO 09/068,628. Coupling of a biparatopic (or multiparatopic) polypeptide and/or Nanobody of the invention to an Fc portion may also lead to an increased half-life, compared to the corresponding biparatopic (or multiparatopic) polypeptide and/or Nanobody of the invention. For some applications, the use of an Fc portion and/or of constant domains (i.e. $C_H2$ and/or $C_H3$ domains) that confer increased half-life without any biologically significant effector function may also be suitable or even preferred. Other suitable constructs comprising one or more biparatopic (or multiparatopic) polypeptides and/or Nanobodies and one or more constant domains with increased half-life in vivo will be clear to the skilled person, and may for example comprise two biparatopic (or multiparatopic) polypeptides and/or Nanobodies linked to a $C_H3$ domain, optionally via a linker sequence, Generally, any fusion protein or derivatives with increased half-life will preferably have a molecular weight of more than 50 kD, the cut-off value for renal absorption.

In another one specific, but non-limiting, aspect, in order to form a polypeptide of the invention, one or more biparatopic (or multiparatopic) polypeptides and/or amino acid sequences of the invention may be linked (optionally via a suitable linker or hinge region) to naturally occurring, synthetic or semisynthetic constant domains (or analogs, variants, mutants, parts or fragments thereof) that have a reduced (or essentially no) tendency to self-associate into dimers (i.e. compared to constant domains that naturally occur in conventional 4-chain antibodies). Such monomeric (i.e. not self-associating) Fc chain variants, or fragments thereof, will be clear to the skilled person. For example, Helm et al., J Biol Chem 1996 271 7494, describe monomeric Fc chain variants that can be used in the polypeptide chains of the invention.

Also, such monomeric Fc chain variants are preferably such that they are still capable of binding to the complement or the relevant Fc receptor(s) (depending on the Fc portion from which they are derived), and/or such that they still have some or all of the effector functions of the Fc portion from which they are derived (or at a reduced level still suitable for the intended use). Alternatively, in such a polypeptide chain of the invention, the monomeric Fc chain may be used to confer increased half-life upon the polypeptide chain, in which case the monomeric Fc chain may also have no or essentially no effector functions.

Bivalent/multivalent, bispecific/multispecific or biparatopic/multiparatopic polypeptides of the invention may also be linked to Fc portions, in order to provide polypeptide constructs of the type that is described in WO 09/068,630.

The further amino acid sequences may also form a signal sequence or leader sequence that directs secretion of the biparatopic (or multiparatopic) polypeptide, Nanobody or the polypeptide of the invention from a host cell upon synthesis (for example to provide a pre-, pro- or prepro-form of the polypeptide of the invention, depending on the host cell used to express the polypeptide of the invention).

The further amino acid sequence may also form a sequence or signal that allows the biparatopic (or multiparatopic) polypeptides, Nanobody or polypeptide of the invention to be directed towards and/or to penetrate or enter into specific organs, tissues, cells, or parts or compartments of cells, and/or that allows the biparatopic (or multiparatopic) polypeptide, Nanobody or polypeptide of the invention to penetrate or cross a biological barrier such as a cell membrane, a cell layer such as a layer of epithelial cells, a tumor including solid tumors, or the blood-brain-barrier. Suitable examples of such amino acid sequences will be clear to the skilled person, and for example include, but are not limited to, those mentioned on page 118 of WO 08/020, 079.

According to one preferred, but non-limiting aspect, said one or more further amino acid sequences comprise at least one further Nanobody, so as to provide a polypeptide of the invention that comprises at least two, such as three, four, five or more Nanobodies, in which said Nanobodies may optionally be linked via one or more linker sequences (as defined herein). As described on pages 119 and 120 of WO 08/020, 079, polypeptides of the invention that comprise two or more Nanobodies, of which at least one is a Nanobody of the invention, will also be referred to herein as "multivalent" polypeptides of the invention, and the Nanobodies present in such polypeptides will also be referred to herein as being in a "multivalent format". For example, "bivalent" and "trivalent" polypeptides of the invention may be as further described on pages 119 and 120 of WO 08/020,079.

One preferred, but non-limiting example of a multispecific polypeptide of the invention comprises at least one biparatopic (or multiparatopic) polypeptides and/or Nanobody of the invention and at least one Nanobody that provides for an increased half-life. Such Nanobodies may for example be Nanobodies that are directed against a serum protein, and in particular a human serum protein, such as human serum albumin, thyroxine-binding protein, (human) transferrin, fibrinogen, an immunoglobulin such as IgG, IgE or IgM, or against one of the serum proteins listed in WO 04/003019. Of these, Nanobodies that can bind to serum albumin (and in particular human serum albumin) or to IgG (and in particular human IgG, see for example Nanobody VH-1 described in the review by Muyldermans, supra) are particularly preferred (although for example, for experiments in mice or primates, Nanobodies against or cross-reactive with mouse serum albumin (MSA) or serum albumin from said primate, respectively, can be used. However, for pharmaceutical use, Nanobodies against human serum albumin or human IgG will usually be preferred). Nanobodies that provide for increased half-life and that can be used in the polypeptides of the invention include the Nanobodies directed against serum albumin that are described in WO 04/041865, in WO 06/122787 and in the further patent applications by Ablynx N.V., such as those mentioned above.

For example, the some preferred Nanobodies that provide for increased half-life for use in the present invention include Nanobodies that can bind to amino acid residues on (human) serum albumin that are not involved in binding of serum albumin to FcRn (see for example WO 06/0122787); Nanobodies that are capable of binding to amino acid residues on serum albumin that do not form part of domain III of serum albumin (see for example WO 06/0122787); Nanobodies that have or can provide an increased half-life (see for example WO 08/028,977 by Ablynx N.V mentioned herein); Nanobodies against human serum albumin that are cross-reactive with serum albumin from at least one species of mammal, and in particular with at least one species of primate (such as, without limitation, monkeys from the genus *Macaca* (such as, and in particular, cynomologus monkeys (*Macaca fascicularis*) and/or rhesus monkeys (*Macaca mulatto*)) and baboon (*Papio ursinus*)) (see for example WO 08/028,977 by Abiynx N.V)); Nanobodies that can bind to serum albumin in a pH independent manner (see for example WO 08/043,821 by Abiynx N.V. mentioned herein) and/or Nanobodies that are conditional binders (see for example WO 08/043,822 by Ablynx N.V.).

Some particularly preferred Nanobodies that provide for increased half-life and that can be used in the polypeptides of the invention include the Nanobodies ALB-1 to ALB-10 disclosed in WO 06/122787 (see Tables II and III) of which ALB-8 (SEQ ID NO: 62 in WO 06/122787) is particularly preferred.

According to a specific, but non-limiting aspect of the invention, the polypeptides of the invention contain, besides the one or more biparatopic (or multiparatopic) polypeptides and/or Nanobodies of the invention, at least one Nanobody against human serum albumin.

Generally, any polypeptides of the invention with increased half-life that contain one or more biparatopic (or multiparatopic) polypeptides and/or Nanobodies of the invention, and any derivatives of biparatopic (or multiparatopic) polypeptides and/or Nanobodies of the invention or of such polypeptides that have an increased half-life, preferably have a half-life that is at least 1.5 times, preferably at least 2 times, such as at least 5 times, for example at least 10 times or more than 20 times, greater than the half-life of the corresponding biparatopic (or multiparatopic) polypeptide and/or Nanobody of the invention per se. For example, such a derivative or polypeptides with increased half-life may have a half-life that is increased with more than 1 hours, preferably more than 2 hours, more preferably more than 6 hours, such as more than 12 hours, or even more than 24, 48 or 72 hours, compared to the corresponding biparatopic (or multiparatopic) polypeptide and/or Nanobody of the invention per se.

In a preferred, but non-limiting aspect of the invention, such derivatives or polypeptides may exhibit a serum half-life in human of at least about 12 hours, preferably at least 24 hours, more preferably at least 48 hours, even more preferably at least 72 hours or more. For example, such derivatives or polypeptides may have a half-life of at least 5 days (such as about 5 to 10 days), preferably at least 9 days (such as about 9 to 14 days), more preferably at least about 10 days (such as about 10 to 15 days), or at least about 11 days (such as about 11 to 16 days), more preferably at least about 12 days (such as about 12 to 18 days or more), or more than 14 days (such as about 14 to 19 days).

According to one aspect of the invention the polypeptides are capable of binding to one or more molecules which can increase the half-life of the polypeptide in vivo.

The polypeptides of the invention are stabilised in vivo and their half-life increased by binding to molecules which resist degradation and/or clearance or sequestration. Typically, such molecules are naturally occurring proteins which themselves have a long half-life in vivo.

Another preferred, but non-limiting example of a multi-specific polypeptide of the invention comprises at least one biparatopic (or multiparatopic) polypeptide and/or Nanobody of the invention and at least one Nanobody that directs the polypeptide of the invention towards, and/or that allows the polypeptide of the invention to penetrate or to enter into specific organs, tissues, cells, or parts or compartments of cells, and/or that allows the biparatopic (or multiparatopic) polypeptide and/or Nanobody to penetrate or cross a biological barrier such as a cell membrane, a cell layer such as a layer of epithelial cells, a tumor including solid tumors, or the blood-brain-barrier. Examples of such Nanobodies include Nanobodies that are directed towards specific cell-surface proteins, markers or epitopes of the desired organ, tissue or cell (for example cell-surface markers associated with tumor cells), and the single-domain brain targeting antibody fragments described in WO 02/057445 and WO 06/040153, of which FC44 (SEQ ID NO: 189 of WO 06/040153) and FC5 (SEQ ID NO: 190 of WO 06/040154) are preferred examples.

The invention also comprises derivatives of the polypeptides of the invention, which may be essentially analogous to the derivatives of the Nanobodies of the invention, i.e. as described herein.

The invention also comprises proteins or polypeptides that "essentially consist" of a polypeptide of the invention (in which the wording "essentially consist of" has essentially the same meaning as indicated hereinabove).

According to one aspect of the invention, the polypeptide of the invention is in essentially isolated from, as defined herein.

The amino acid sequences, Nanobodies, polypeptides and nucleic acids of the invention can be prepared in a manner known per se, as will be clear to the skilled person from the further description herein. For example, the Nanobodies and polypetides of the invention can be prepared in any manner known per se for the preparation of antibodies and in particular for the preparation of antibody fragments (including but not limited to (single) domain antibodies and ScFv fragments). Some preferred, but non-limiting methods for preparing the amino acid sequences, Nanobodies, polypeptides and nucleic acids include the methods and techniques described herein.

As will be clear to the skilled person, one particularly useful method for preparing an amino acid sequence, Nanobody and/or a polypeptide of the invention generally comprises the steps of:

i) the expression, in a suitable host cell or host organism (also referred to herein as a "host of the invention") or in another suitable expression system of a nucleic acid that encodes said amino acid sequence, Nanobody or polypeptide of the invention (also referred to herein as a "nucleic acid of the invention"), optionally followed by:

ii) isolating and/or purifying the amino acid sequence, Nanobody or polypeptide of the invention thus obtained.

In particular, such a method may comprise the steps of:

i) cultivating and/or maintaining a host of the invention under conditions that are such that said host of the invention expresses and/or produces at least one amino acid sequence, Nanobody and/or polypeptide of the invention; optionally followed by:

ii) isolating and/or purifying the amino acid sequence, Nanobody or polypeptide of the invention thus obtained.

A nucleic acid of the invention can be in the form of single or double stranded DNA or RNA, and is preferably in the form of double stranded DNA. For example, the nucleotide sequences of the invention may be genomic DNA, cDNA or synthetic DNA (such as DNA with a codon usage that has been specifically adapted for expression in the intended host cell or host organism).

According to one aspect of the invention, the nucleic acid of the invention is in essentially isolated from, as defined herein.

The nucleic acid of the invention may also be in the form of, be present in and/or be part of a vector, such as for example a plasmid, cosmid or YAC, which again may be in essentially isolated form.

The nucleic acids of the invention can be prepared or obtained in a manner known per se, based on the information on the amino acid sequences for the polypeptides of the invention given herein, and/or can be isolated from a suitable natural source. To provide analogs, nucleotide sequences encoding naturally occurring $V_{HH}$ domains can for example be subjected to site-directed mutagenesis, so at to provide a nucleic acid of the invention encoding said analog. Also, as will be clear to the skilled person, to prepare a nucleic acid of the invention, also several nucleotide sequences, such as at least one nucleotide sequence encoding a Nanobody and for example nucleic acids encoding one or more linkers can be linked together in a suitable manner.

Techniques for generating the nucleic acids of the invention will be clear to the skilled person and may for instance include, but are not limited to, automated DNA synthesis; site-directed mutagenesis; combining two or more naturally occurring and/or synthetic sequences (or two or more parts thereof), introduction of mutations that lead to the expression of a truncated expression product; introduction of one or more restriction sites (e.g. to create cassettes and/or regions that may easily be digested and/or ligated using suitable restriction enzymes), and/or the introduction of mutations by means of a PCR reaction using one or more "mismatched" primers, using for example a sequence of a naturally occurring form of IL-6R as a template. These and other techniques will be clear to the skilled person, and reference is again made to the standard handbooks, such as Sambrook et al. and Ausubel et al., mentioned above, as well as the Examples below.

The nucleic acid of the invention may also be in the form of, be present in and/or be part of a genetic construct, as will be clear to the person skilled in the art and as described on pages 131-134 of WO 08/020,079 (incorporated herein by reference). Such genetic constructs generally comprise at least one nucleic acid of the invention that is optionally linked to one or more elements of genetic constructs known per se, such as for example one or more suitable regulatory elements (such as a suitable promoter(s), enhancer(s), terminator(s), etc.) and the further elements of genetic constructs referred to herein. Such genetic constructs comprising at least one nucleic acid of the invention will also be referred to herein as "genetic constructs of the invention".

The genetic constructs of the invention may be DNA or RNA, and are preferably double-stranded DNA. The genetic constructs of the invention may also be in a form suitable for transformation of the intended host cell or host organism, in a form suitable for integration into the genomic DNA of the intended host cell or in a form suitable for independent replication, maintenance and/or inheritance in the intended host organism. For instance, the genetic constructs of the invention may be in the form of a vector, such as for example a plasmid, cosmid, YAC, a viral vector or transposon. In particular, the vector may be an expression vector, i.e. a vector that can provide for expression in vitro and/or in vivo (e.g. in a suitable host cell, host organism and/or expression system).

In a preferred but non-limiting aspect, a genetic construct of the invention comprises
i) at least one nucleic acid of the invention; operably connected to
ii) one or more regulatory elements, such as a promoter and optionally a suitable terminator;
and optionally also
iii) one or more further elements of genetic constructs known per se;
in which the terms "operably connected" and "operably linked" have the meaning given on pages 131-134 of WO 08/020,079; and in which the "regulatory elements", "promoter", "terminator" and "further elements" are as described on pages 131-134 of WO 08/020,079; and in which the genetic constructs may further be as described on pages 131-134 of WO 08/020,079.

The nucleic acids of the invention and/or the genetic constructs of the invention may be used to transform a host cell or host organism, i.e. for expression and/or production of the amino acid sequence, Nanobody or polypeptide of the invention. Suitable hosts or host cells will be clear to the skilled person, and may for example be any suitable fungal, prokaryotic or eukaryotic cell or cell line or any suitable fungal, prokaryotic or eukaryotic organism, for example those described on pages 134 and 135 of WO 08/020,079; as well as all other hosts or host cells known per se for the expression and production of antibodies and antibody fragments (including but not limited to (single) domain antibodies and ScFv fragments), which will be clear to the skilled person. Reference is also made to the general background art cited hereinabove, as well as to for example WO 94/29457; WO 96/34103; WO 99/42077; Frenken et al., (1998), supra; Riechmann and Muyldermans, (1999), supra; van der Linden, (2000), supra; Thomassen et al., (2002), supra; Joosten et al., (2003), supra; Joosten et al., (2005), supra; and the further references cited herein.

The amino acid sequences, Nanobodies and polypeptides of the invention can also be introduced and expressed in one or more cells, tissues or organs of a multicellular organism, for example for prophylactic and/or therapeutic purposes (e.g. as a gene therapy), as further described on pages 135 and 136 of in WO 08/020,079 and in the further references cited in WO 08/020,079.

For expression of the Nanobodies in a cell, they may also be expressed as so-called "intrabodies", as for example described in WO 94/02610, WO 95/22618 and U.S. Pat. No. 7,004,940; WO 03/014960; in Cattaneo, A. & Biocca, S. (1997) Intracellular Antibodies: Development and Applications. Landes and Springer-Verlag; and in Kontermann, Methods 34, (2004), 163-170.

The amino acid sequences, Nanobodies and polypeptides of the invention can for example also be produced in the milk of transgenic mammals, for example in the milk of rabbits, cows, goats or sheep (see for example U.S. Pat. Nos. 6,741,957, 6,304,489 and 6,849,992 for general techniques for introducing transgenes into mammals), in plants or parts of plants including but not limited to their leaves, flowers, fruits, seed, roots or turbers (for example in tobacco, maize, soybean or alfalfa) or in for example pupae of the silkworm *Bornbix mori*.

Furthermore, the amino acid sequences, Nanobodies and polypeptides of the invention can also be expressed and/or produced in cell-free expression systems, and suitable examples of such systems will be clear to the skilled person. Some preferred, but non-limiting examples include expression in the wheat germ system; in rabbit reticulocyte lysates; or in the *E. coli* Zubay system.

As mentioned above, one of the advantages of the use of Nanobodies is that the polypeptides based thereon can be prepared through expression in a suitable bacterial system, and suitable bacterial expression systems, vectors, host cells, regulatory elements, etc., will be clear to the skilled person, for example from the references cited above. It should however be noted that the invention in its broadest sense is not limited to expression in bacterial systems.

Preferably, in the invention, an (in vivo or in vitro) expression system, such as a bacterial expression system, is used that provides the polypeptides of the invention in a form that is suitable for pharmaceutical use, and such expression systems will again be clear to the skilled person.

As also will be clear to the skilled person, polypeptides of the invention suitable for pharmaceutical use can be prepared using techniques for peptide synthesis.

For production on industrial scale, preferred heterologous hosts for the (industrial) production of Nanobodies or Nanobody-containing protein therapeutics include strains of *E. coli, Pichia pastoris, S. cerevisiae* that are suitable for large scale expression/production/fermentation, and in particular for large scale pharmaceutical (i.e. GMP grade) expression/production/fermentation. Suitable examples of such strains will be clear to the skilled person. Such strains and production/expression systems are also made available by companies such as Biovitrum (Uppsala, Sweden).

Alternatively, mammalian cell lines, in particular Chinese hamster ovary (CHO) cells, can be used for large scale expression/production/fermentation, and in particular for large scale pharmaceutical expression/production/fermentation. Again, such expression/production systems are also made available by some of the companies mentioned above.

The choice of the specific expression system would depend in part on the requirement for certain post-translational modifications, more specifically glycosylation. The production of a Nanobody-containing recombinant protein for which glycosylation is desired or required would necessitate the use of mammalian expression hosts that have the ability to glycosylate the expressed protein. In this respect, it will be clear to the skilled person that the glycosylation pattern obtained (i.e. the kind, number and position of residues attached) will depend on the cell or cell line that is used for the expression. Preferably, either a human cell or cell line is used (i.e. leading to a protein that essentially has a human glycosylation pattern) or another mammalian cell line is used that can provide a glycosylation pattern that is essentially and/or functionally the same as human glycosylation or at least mimics human glycosylation. Generally, prokaryotic hosts such as *E. coli* do not have the ability to glycosylate proteins, and the use of lower eukaryotes such as yeast usually leads to a glycosylation pattern that differs from human glycosylation. Nevertheless, it should be understood that all the foregoing host cells and expression systems can be used in the invention, depending on the desired amino acid sequence, Nanobody or polypeptide to be obtained.

Thus, according to one non-limiting aspect of the invention, the amino acid sequence, Nanobody or polypeptide of the invention is glycosylated. According to another non-limiting aspect of the invention, the amino acid sequence, Nanobody or polypeptide of the invention is non-glycosylated.

According to one preferred, but non-limiting aspect of the invention, the amino acid sequence, Nanobody or polypeptide of the invention is produced in a bacterial cell, in particular a bacterial cell suitable for large scale pharmaceutical production, such as cells of the strains mentioned above.

According to another preferred, but non-limiting aspect of the invention, the amino acid sequence, Nanobody or polypeptide of the invention is produced in a yeast cell, in particular a yeast cell suitable for large scale pharmaceutical production, such as cells of the species mentioned above.

According to yet another preferred, but non-limiting aspect of the invention, the amino acid sequence, Nanobody or polypeptide of the invention is produced in a mammalian cell, in particular in a human cell or in a cell of a human cell line, and more in particular in a human cell or in a cell of a human cell line that is suitable for large scale pharmaceutical production, such as the cell lines mentioned hereinabove.

As further described on pages 138 and 139 of WO 08/020,079, when expression in a host cell is used to produce the amino acid sequences, Nanobodies and the polypeptides of the invention, the amino acid sequences, Nanobodies and polypeptides of the invention can be produced either intracellularly (e.g. in the cytosol, in the periplasma or in inclusion bodies) and then isolated from the host cells and optionally further purified; or can be produced extracellularly (e.g. in the medium in which the host cells are cultured) and then isolated from the culture medium and optionally further purified. Thus, according to one non-limiting aspect of the invention, the amino acid sequence, Nanobody or polypeptide of the invention is an amino acid sequence, Nanobody or polypeptide that has been produced intracellularly and that has been isolated from the host cell, and in particular from a bacterial cell or from an inclusion body in a bacterial cell. According to another non-limiting aspect of the invention, the amino acid sequence, Nanobody or polypeptide of the invention is an amino acid sequence, Nanobody or polypeptide that has been produced extracellularly, and that has been isolated from the medium in which the host cell is cultivated.

Some preferred, but non-limiting promoters for use with these host cells include those mentioned on pages 139 and 140 of WO 08/020,079.

Some preferred, but non-limiting secretory sequences for use with these host cells include those mentioned on page 140 of WO 08/020,079.

Suitable techniques for transforming a host or host cell of the invention will be clear to the skilled person and may depend on the intended host cell/host organism and the genetic construct to be used. Reference is again made to the handbooks and patent applications mentioned above.

After transformation, a step for detecting and selecting those host cells or host organisms that have been successfully transformed with the nucleotide sequence/genetic construct of the invention may be performed. This may for instance be a selection step based on a selectable marker present in the genetic construct of the invention or a step involving the detection of the amino acid sequence of the invention, e.g. using specific antibodies.

The transformed host cell (which may be in the form or a stable cell line) or host organisms (which may be in the form of a stable mutant line or strain) form further aspects of the present invention.

Preferably, these host cells or host organisms are such that they express, or are (at least) capable of expressing (e.g. under suitable conditions), an amino acid sequence, Nanobody or polypeptide of the invention (and in case of a host organism: in at least one cell, part, tissue or organ thereof). The invention also includes further generations, progeny and/or offspring of the host cell or host organism of the invention, that may for instance be obtained by cell division or by sexual or asexual reproduction.

To produce/obtain expression of the amino acid sequences of the invention, the transformed host cell or transformed host organism may generally be kept, maintained and/or cultured under conditions such that the (desired) amino acid sequence, Nanobody or polypeptide of the invention is expressed/produced. Suitable conditions will be clear to the skilled person and will usually depend upon the host cell/host organism used, as well as on the regulatory elements that control the expression of the (relevant) nucleotide sequence of the invention. Again, reference is made to the handbooks and patent applications mentioned above in the paragraphs on the genetic constructs of the invention.

Generally, suitable conditions may include the use of a suitable medium, the presence of a suitable source of food and/or suitable nutrients, the use of a suitable temperature, and optionally the presence of a suitable inducing factor or compound (e.g. when the nucleotide sequences of the invention are under the control of an inducible promoter); all of which may be selected by the skilled person. Again, under such conditions, the amino acid sequences of the invention may be expressed in a constitutive manner, in a transient manner, or only when suitably induced.

It will also be clear to the skilled person that the amino acid sequence, Nanobody or polypeptide of the invention may (first) be generated in an immature form (as mentioned above), which may then be subjected to post-translational modification, depending on the host cell/host organism used. Also, the amino acid sequence, Nanobody or polypeptide of the invention may be glycosylated, again depending on the host cell/host organism used.

The amino acid sequence, Nanobody or polypeptide of the invention may then be isolated from the host cell/host organism and/or from the medium in which said host cell or host organism was cultivated, using protein isolation and/or purification techniques known per se, such as (preparative) chromatography and/or electrophoresis techniques, differential precipitation techniques, affinity techniques (e.g. using a specific, cleavable amino acid sequence fused with the amino acid sequence, Nanobody or polypeptide of the invention) and/or preparative immunological techniques (i.e. using antibodies against the amino acid sequence to be isolated).

Generally, for pharmaceutical use, the polypeptides of the invention may be formulated as a pharmaceutical preparation or compositions comprising at least one polypeptide of the invention and at least one pharmaceutically acceptable carrier, diluent or excipient and/or adjuvant, and optionally one or more further pharmaceutically active polypeptides and/or compounds. By means of non-limiting examples, such a formulation may be in a form suitable for oral administration, for parenteral administration (such as by intravenous, intramuscular or subcutaneous injection or intravenous infusion), for topical administration, for administration by inhalation, by a skin patch, by an implant, by a suppository, etc. Such suitable administration forms—which may be solid, semi-solid or liquid, depending on the manner of administration—as well as methods and carriers for use in the preparation thereof, will be clear to the skilled person, and are further described herein.

Thus, in a further aspect, the invention relates to a pharmaceutical composition that contains at least one amino acid of the invention, at least one Nanobody of the invention or at least one polypeptide of the invention and at least one suitable carrier, diluent or excipient (i.e. suitable for pharmaceutical use), and optionally one or more further active substances.

Generally, the amino acid sequences, Nanobodies and polypeptides of the invention can be formulated and administered in any suitable manner known per se, for which reference is for example made to the general background art cited above (and in particular to WO 04/041862, WO 04/041863, WO 04/041865, WO 04/041867 and WO 08/020,079) as well as to the standard handbooks, such as Remington's Pharmaceutical Sciences, 18$^{th}$ Ed., Mack Publishing Company, USA (1990), Remington, the Science and Practice of Pharmacy, 21th Edition, Lippincott Williams and Wilkins (2005); or the Handbook of Therapeutic Antibodies (S. Dubel, Ed.), Wiley, Weinheim, 2007 (see for example pages 252-255).

For example, the amino acid sequences, Nanobodies and polypeptides of the invention may be formulated and administered in any manner known per se for conventional antibodies and antibody fragments (including ScFv's and diabodies) and other pharmaceutically active proteins. Such formulations and methods for preparing the same will be clear to the skilled person, and for example include preparations suitable for parenteral administration (for example intravenous, intraperitoneal, subcutaneous, intramuscular, intraluminal, intra-arterial or intrathecal administration) or for topical (i.e. transdermal or intradermal) administration.

Preparations for parenteral administration may for example be sterile solutions, suspensions, dispersions or emulsions that are suitable for infusion or injection. Suitable carriers or diluents for such preparations for example include, without limitation, those mentioned on page 143 of WO 08/020,079. Usually, aqueous solutions or suspensions will be preferred.

The amino acid sequences, Nanobodies and polypeptides of the invention can also be administered using gene therapy methods of delivery. See, e.g., U.S. Pat. No. 5,399,346, which is incorporated by reference in its entirety. Using a gene therapy method of delivery, primary cells transfected with the gene encoding an amino acid sequence, Nanobody or polypeptide of the invention can additionally be transfected with tissue specific promoters to target specific organs, tissue, grafts, tumors, or cells and can additionally be transfected with signal and stabilization sequences for subcellularly localized expression.

Thus, the amino acid sequences, Nanobodies and polypeptides of the invention may be systemically administered, e.g., orally, in combination with a pharmaceutically acceptable vehicle such as an inert diluent or an assimilable edible carrier. They may be enclosed in hard or soft shell gelatin capsules, may be compressed into tablets, or may be incorporated directly with the food of the patient's diet. For oral therapeutic administration, the amino acid sequences, Nanobodies and polypeptides of the invention may be combined with one or more excipients and used in the form of ingestible tablets, buccal tablets, troches, capsules, elixirs, suspensions, syrups, wafers, and the like. Such compositions and preparations should contain at least 0.1% of the amino acid sequence, Nanobody or polypeptide of the invention. Their percentage in the compositions and preparations may, of course, be varied and may conveniently be between about 2 to about 60% of the weight of a given unit dosage form. The amount of the amino acid sequence, Nanobody or polypeptide of the invention in such therapeutically useful compositions is such that an effective dosage level will be obtained.

The tablets, troches, pills, capsules, and the like may also contain binders, excipients, disintegrating agents, lubricants and sweetening or flavouring agents, for example those mentioned on pages 143-144 of WO 08/020,079. When the unit dosage form is a capsule, it may contain, in addition to materials of the above type, a liquid carrier, such as a vegetable oil or a polyethylene glycol. Various other materials may be present as coatings or to otherwise modify the physical form of the solid unit dosage form. For instance, tablets, pills, or capsules may be coated with gelatin, wax, shellac or sugar and the like. A syrup or elixir may contain the amino acid sequences, Nanobodies and polypeptides of the invention, sucrose or fructose as a sweetening agent, methyl and propylparabens as preservatives, a dye and flavoring such as cherry or orange flavor. Of course, any material used in preparing any unit dosage form should be pharmaceutically acceptable and substantially non-toxic in the amounts employed. In addition, the amino acid sequences, Nanobodies and polypeptides of the invention may be incorporated into sustained-release preparations and devices.

Preparations and formulations for oral administration may also be provided with an enteric coating that will allow the constructs of the invention to resist the gastric environment and pass into the intestines. More generally, preparations and formulations for oral administration may be suitably formulated for delivery into any desired part of the gastrointestinal tract. In addition, suitable suppositories may be used for delivery into the gastrointestinal tract.

The amino acid sequences, Nanobodies and polypeptides of the invention may also be administered intravenously or intraperitoneally by infusion or injection, as further described on pages 144 and 145 of WO 08/020,079.

For topical administration, the amino acid sequences, Nanobodies and polypeptides of the invention may be applied in pure form, i.e., when they are liquids. However, it will generally be desirable to administer them to the skin as compositions or formulations, in combination with a dermatologically acceptable carrier, which may be a solid or a liquid, as further described on page 145 of WO 08/020, 079.

Generally, the concentration of the amino acid sequences, Nanobodies and polypeptides of the invention in a liquid composition, such as a lotion, will be from about 0.1-25 wt-%, preferably from about 0.5-10 wt-%. The concentration in a semi-solid or solid composition such as a gel or a powder will be about 0.1-5 wt-%, preferably about 0.5-2.5 wt-%.

The amount of the amino acid sequences, Nanobodies and polypeptides of the invention required for use in treatment will vary not only with the particular amino acid sequence, Nanobody or polypeptide selected but also with the route of administration, the nature of the condition being treated and the age and condition of the patient and will be ultimately at the discretion of the attendant physician or clinician. Also the dosage of the amino acid sequences, Nanobodies and polypeptides of the invention varies depending on the target cell, tumor, tissue, graft, or organ.

The desired dose may conveniently be presented in a single dose or as divided doses administered at appropriate intervals, for example, as two, three, four or more sub-doses per day. The sub-dose itself may be further divided, e.g., into a number of discrete loosely spaced administrations; such as multiple inhalations from an insufflator or by application of a plurality of drops into the eye.

An administration regimen could include long-term, daily treatment. By "long-term" is meant at least two weeks and preferably, several weeks, months, or years of duration. Necessary modifications in this dosage range may be determined by one of ordinary skill in the art using only routine experimentation given the teachings herein. See Remington's Pharmaceutical Sciences (Martin, E. W., ed. 4), Mack Publishing Co., Easton, Pa. The dosage can also be adjusted by the individual physician in the event of any complication.

The invention further relates to applications and uses of the amino acid sequences, compounds, constructs, polypeptides, nucleic acids, host cells, products and compositions described herein, as well as to methods for the prevention and/or treatment for diseases and disorders associated with IL-6R. Some preferred but non-limiting applications and uses will become clear from the further description herein.

The amino acid sequences, Nanobodies, compounds, constructs, polypeptides, and preferably biparatopic (or multiparatopic) polypeptides, and compositions of the present invention can generally be used to modulate, and in particular inhibit and/or prevent, binding of IL-6R to IL-6 and/or binding of the IL-6/IL-6R complex to gp130 and thus to modulate, and in particular inhibit or prevent, the signalling that is mediated by IL-6R, IL-6, IL6/IL-6R complex or gp130 to modulate the biological pathways in which IL-6R, IL-6, the IL6/IL-6R complex and/or gp130 are involved, and/or to modulate the biological mechanisms, responses and effects associated with such signalling or these pathways.

In the context of the present invention "modulating the interaction between IL-6/IL-6R complex and gp130" can for example mean:

binding to IL-6R (i.e. as such or as present in the IL-6/IL-6R complex) in such a way that the formation of the IL-6/IL-6R complex is inhibited or affected (e.g. fully or partially disrupted) in such a way that the binding of the complex to—e.g. its affinity for—gp130 is reduced (or reversely, that the binding of gp 130 to—e.g. its affinity for—the complex is reduced), so that the signaling induced/mediated by the binding of the complex to gp130 is modulated (e.g. reduced);

or binding to IL-6R (i.e. as such or as present in the IL-6/IL-6R complex) in such a way that the formation of the IL-6/IL-6R complex essentially is not affected but that the binding of said complex to gp130 is modulated (e.g. inhibited), so that the signalling induced/mediated by the binding of the complex to gp130 is modulated (e.g. reduced);

both compared to the formation of the complex and its binding to gp130 without the presence of the amino acid sequence, Nanobody, compound, construct, polypeptide, and preferably biparatopic (or multiparatopic) polypeptide, and composition of the present invention.

Accordingly, in one specific, but non-limiting aspect, the invention provides amino acid sequences, Nanobodies, compounds, constructs, polypeptides, and preferably biparatopic (or multiparatopic) polypeptides, and compositions that are, and/or that can be used as, an antagonist of IL-6, of IL-6R, of IL-6- or IL-6R-mediated signalling, and/or of the biological pathways mechanisms, responses and/or effects in which IL-6, IL-6R and/or IL-6- or IL-6R mediated signalling are involved.

In another specific, but non-limiting aspect, the amino acid sequences, Nanobodies, compounds, polypeptides and preferably biparatopic (or multiparatopic) polypeptides described herein are such that they (a) specifically bind (as defined herein) to the IL-6 receptor; and (b) are capable of downregulating the IL-6 receptor and/or are capable of inhibiting, decreasing or downregulating the signalling of the IL-6 receptor and/or the pathway(s), mechanism(s) or signalling in which the IL-6 or IL-6R is involved. As will be clear to the skilled person, such an amino acid sequence, Nanobody, compound, polypeptide and preferably biparatopic (or multiparatopic) polypeptide can generally be used as an antagonist of IL-6, of the IL-6 receptor and/or of the biological pathways, mechanisms or effects in which IL-6, Il-6R and/or Il-6/IL-6R mediated signalling is involved. Any such decrease or downregulation (which can be at least 1%, such as at least 5%, or more than 10%, or up to 50% or 100% or more in a relevant parameter, compared to the same parameter under conditions in which the amino acid sequence, Nanobody, compound, polypeptide and preferably biparatopic (or multiparatopic) polypeptide is not bound to the IL-6 receptor), may be measured in any suitable manner known per se, for example using one of the assays used in the Experimental Part and/or mentioned herein.

For example, such antagonistic amino acid sequences, Nanobodies, compounds, polypeptides and preferably biparatopic (or multiparatopic) polypeptides may be competitive of non-competitive inhibitors of the binding of IL-6 to IL-6R.

More in particular, and in addition to (a) and (b) above, and optionally in addition to (d) and/or (e) below, such antagonistic the amino acid sequences, Nanobodies, compounds, polypeptides and preferably biparatopic (or multiparatopic) polypeptides may bind to IL-6R in such a way that (c) binding of IL-6 to IL-6R is blocked, inhibited or reduced; compared to the binding of IL-6 to its receptor without the presence of the amino acid sequence, Nanobody, compound, polypeptide and preferably biparatopic (or multiparatopic) polypeptide.

For example, and without limitation, such antagonistic the amino acid sequences, Nanobodies, compounds, polypeptides and preferably biparatopic (or multiparatopic) polypeptides may bind to or close to the IL-6 binding site on IL-6R.

Also, in addition to (a) and (b) above, and optionally in addition to (c) above or (e) below, such antagonistic amino acid sequences, Nanobodies, compounds, polypeptides and preferably biparatopic (or multiparatopic) polypeptides may bind to IL-6R (i.e. as such or as present in the IL-6/IL-6R complex) in such a way that (d) the formation of the IL-6/IL-6R complex is inhibited or affected (e.g. fully or partially disrupted) in such a way that the binding of the complex to—e.g. its affinity for—gp130 is reduced (or reversely, that the binding of gp 130 to—e.g. its affinity for—the complex is reduced), so that the signaling induced/mediated by the binding of the complex to gp130 is modulated (e.g. reduced); compared to the formation of the complex and its binding to gp130 without the presence of the amino acid sequence, Nanobody, compound, polypeptide and preferably biparatopic (or multiparatopic) polypeptide of the invention.

Also, in addition to (a) and (b) above, and optionally in addition to (c) or (d) above, such antagonistic amino acid sequences, Nanobodies, compounds, polypeptides and preferably biparatopic (or multiparatopic) polypeptides may bind to IL-6R (i.e. as such or as present in the IL-6/IL-6R complex) in such a way that (e) that the formation of the IL-6/IL-6R complex essentially is not affected but that the binding of said complex to gp130 is modulated (e.g. inhibited), so that the signalling induced/mediated by the binding of the complex to gp130 is modulated (e.g. reduced); compared to the formation of the complex and its binding to gp130 without the presence of the amino acid sequence, Nanobody, compound, polypeptide and preferably biparatopic (or multiparatopic) polypeptide of the invention.

Alternatively, such antagonistic the amino acid sequences, Nanobodies, compounds, polypeptides and preferably biparatopic (or multiparatopic) polypeptides may bind to another epitope, site, domain or region on the IL-6 receptor (e.g. allosteric binding) such that the IL-6 receptor becomes less sensitive for binding of IL-6 (and/or that the signalling of the IL-6 receptor upon binding of IL-6 is reduced).

It is also possible that such antagonistic the amino acid sequences, Nano bodies, compounds, polypeptides and preferably biparatopic (or multiparatopic) polypeptides may bind to another epitope, site, domain or region on the IL-6 receptor.

Accordingly, in the context of the present invention, "modulating" or "to modulate" generally means exercising an agonistic or antagonistic effect, respectively, with respect to IL-6, IL-6R and/or the biological pathways, responses, signalling, mechanisms or effects in which IL-6 and/or IL-6R is involved. In particular, "modulating" or "to modulate" may mean either an such an agonistic or antagonistic effect (i.e. a full or partial agonistic or antagonistic effect, respectively), as measured using a suitable in vitro, cellular or in vivo assay (such as those mentioned herein), that leads to a change in a relevant parameter by at least 1%, preferably at least 5%, such as at least 10% or at least 25%, for example by at least 50%, at least 60%, at least 70%, at least 80%, or 90% or more, compared to same parameter in the same assay under the same conditions but without the presence of the amino acid sequence, Nanobody, compound, polypeptide and preferably biparatopic (or multiparatopic) polypeptides of the invention.

Without being limiting, in one aspect, the amino acid sequence, Nanobody, polypeptide and preferably biparatopic (or multiparatopic) polypeptide of the invention or the composition comprising the same will inhibit and/or block binding of IL-6 to IL-6R. The amino acid sequence, Nanobody, polypeptide and preferably biparatopic (or multiparatopic) polypeptide of the invention or the composition comprising the same will preferably inhibit binding of IL-6 to IL-6R by at least 1%, preferably at least 5%, such as at least 10%, for example 25% or more or even 50% or more and up to 75% or even more than 90% or more, compared to binding of IL-6 to IL-6R in the absence of the amino acid sequence, Nanobody, polypeptide and preferably biparatopic (or multiparatopic) polypeptide of the invention or the composition comprising the same.

In another aspect, the amino acid sequence, Nanobody, polypeptide and preferably biparatopic (or multiparatopic) polypeptide of the invention or the composition comprising the same will inhibit and/or block binding of the IL-6/IL-6R complex to gp130. The amino acid sequence, Nanobody, polypeptide and preferably biparatopic (or multiparatopic) polypeptide of the invention or the composition comprising the same will preferably inhibit binding of the IL-6/IL-6R complex to gp130 by at least 1%, preferably at least 5%, such as at least 10%, for example 25% or more or even 50% or more and up to 75% or even more than 90% or more, compared to binding of the IL-6/IL-6R complex to gp130 in the absence of the amino acid sequence, Nanobody, polypeptide and preferably biparatopic (or multiparatopic) polypeptide of the invention or the composition comprising the same.

In another aspect, the amino acid sequence, Nanobody, polypeptide and preferably biparatopic (or multiparatopic) polypeptide of the invention or the composition comprising the same will inhibit and/or block binding of the reference IgG (SEQ ID NO's: 126 and 127) and/or reference Fab (SEQ ID NO's: 128 and 129) to IL-6R. The amino acid sequence, Nanobody, polypeptide and preferably biparatopic (or multiparatopic) polypeptide of the invention or the composition comprising the same will preferably inhibit binding of the reference IgG and/or reference Fab to IL-6R by at least 1%, preferably at least 5%, such as at least 10%, for example 25% or more or even 50% or more and up to 75% or even more than 90% or more, compared to binding of the reference IgG and/or reference Fab to IL-6R in the absence of the amino acid sequence, Nanobody, polypeptide and preferably biparatopic (or multiparatopic) polypeptide of the invention or the composition comprising the same.

In another aspect, the amino acid sequence, Nanobody, polypeptide and preferably biparatopic (or multiparatopic) polypeptide of the invention or the composition comprising the same will inhibit and/or block binding of Tocilizumab (MRA) to IL-6R. The amino acid sequence, Nanobody, polypeptide and preferably biparatopic (or multiparatopic) polypeptide of the invention or the composition comprising the same will preferably inhibit binding of Tocilizumab (MRA) to IL-6R by at least 1%, preferably at least 5%, such as at least 10%, for example 25% or more or even 50% or more and up to 75% or even more than 90% or more, compared to binding of Tocilizumab (MRA) in the absence of the amino acid sequence, Nanobody or (biparatopic or multiparatopic) polypeptide of the invention or the composition comprising the same.

In another aspect, the amino acid sequence, Nanobody, polypeptide and preferably biparatopic (or multiparatopic) polypeptide of the invention or the composition comprising the same will inhibit and/or block binding of M182 to IL-6R. The amino acid sequence, Nanobody, polypeptide and preferably biparatopic (or multiparatopic) polypeptide of the invention or the composition comprising the same will preferably inhibit binding M182 to IL-6R by at least 1%, preferably at least 5%, such as at least 10%, for example 25% or more or even 50% or more and up to 75% or even more than 90% or more, compared to binding of M182 in the absence of the amino acid sequence, Nanobody, polypeptide and preferably biparatopic (or multiparatopic) polypeptide of the invention or the composition comprising the same.

In another aspect, the amino acid sequence, Nanobody, polypeptide and preferably biparatopic (or multiparatopic) polypeptide of the invention or the composition comprising the same will inhibit and/or block binding of BN-12 to IL-6R. The amino acid sequence, Nanobody, polypeptide and preferably biparatopic (or multiparatopic) polypeptide of the invention or the composition comprising the same will preferably inhibit binding BN-12 to IL-6R by at least 1%, preferably at least 5%, such as at least 10%, for example 25% or more or even 50% or more and up to 75% or even more than 90% or more, compared to binding of BN-12 in the absence of the amino acid sequence, Nanobody, polypeptide and preferably biparatopic (or multiparatopic) polypeptide of the invention or the composition comprising the same.

In another aspect, the amino acid sequence, Nanobody, polypeptide and preferably biparatopic (or multiparatopic) polypeptide of the invention or the composition comprising the same will inhibit and/or block binding of IL-6 to IL-6R and binding of gp130 to the IL-6/IL-6R complex, preferably essentially simultaneously. The amino acid sequence, Nanobody, polypeptide and preferably biparatopic (or multiparatopic) polypeptide of the invention or the composition comprising the same will preferably inhibit binding of IL-6 to IL-6R by at least 1%, preferably at least 5%, such as at least 10%, for example 25% or more or even 50% or more and up to 75% or even more than 90% or more, compared to binding of IL-6 to IL-6R in the absence of the amino acid sequence, Nanobody, polypeptide and preferably biparatopic (or multiparatopic) polypeptide of the invention or the composition comprising the same; and the amino acid sequence, Nanobody, polypeptide and preferably biparatopic (or multiparatopic) polypeptide of the invention or the composition comprising the same will preferably inhibit binding of gp130 to the IL-6/IL-6R complex by at least 1%, preferably at least 5%, such as at least 10%, for example 25% or more or even 50% or more and up to 75% or even more than 90% or more, compared to binding of gp130 to the IL-6/IL-6R complex in the absence of the amino acid sequence, Nanobody, polypeptide and preferably biparatopic (or multiparatopic) polypeptide of the invention or the composition comprising the same.

In another aspect, the amino acid sequence, Nanobody, polypeptide and preferably biparatopic (or multiparatopic) polypeptide of the invention or the composition comprising the same will inhibit and/or block binding of IL-6 to IL-6R and binding of the reference IgG and/or reference Fab to IL-6R, preferably essentially simultaneously. The amino acid sequence, Nanobody, polypeptide and preferably biparatopic (or multiparatopic) polypeptide of the invention or the composition comprising the same will preferably inhibit binding of IL-6 to IL-6R by at least 1%, preferably at least 5%, such as at least 10%, for example 25% or more or even 50% or more and up to 75% or even more than 90% or more, compared to binding of IL-6 to IL-6R in the absence of the amino acid sequence, Nanobody, polypeptide and preferably biparatopic (or multiparatopic) polypeptide of the invention or the composition comprising the same; and the amino acid sequence, Nanobody, polypeptide and preferably biparatopic (or multiparatopic) polypeptide of the invention or the composition comprising the same will preferably inhibit binding of the reference IgG and/or reference Fab to IL-6R by at least 1%, preferably at least 5%, such as at least 10%, for example 25% or more or even 50% or more and up to 75% or even more than 90% or more, compared to binding of the reference IgG and/or Fab to IL-6R in the absence of the amino acid sequence, Nanobody, polypeptide and preferably biparatopic (or multiparatopic) polypeptide of the invention or the composition comprising the same.

In another aspect, the amino acid sequence, Nanobody, polypeptide and preferably biparatopic (or multiparatopic) polypeptide of the invention or the composition comprising the same will inhibit and/or block binding of IL-6 to IL-6R and binding of Tocilizumab (MRA) to the IL-6R, preferably essentially simultaneously. The amino acid sequence, Nanobody, polypeptide and preferably biparatopic (or multiparatopic) polypeptide of the invention or the composition comprising the same will preferably inhibit binding of IL-6 to IL-6R by at least 1%, preferably at least 5%, such as at least 10%, for example 25% or more or even 50% or more and up to 75% or even more than 90% or more, compared to binding of IL-6 to IL-6R in the absence of the amino acid sequence, Nanobody, polypeptide and preferably biparatopic (or multiparatopic) polypeptide of the invention or the composition comprising the same; and the amino acid sequence, Nanobody, polypeptide and preferably biparatopic (or multiparatopic) polypeptide of the invention or the composition comprising the same will preferably inhibit binding of Tocilizumab (MRA) to IL-6R by at least 1%, preferably at least 5%, such as at least 10%, for example 25% or more or even 50% or more and up to 75% or even more than 90% or more, compared to binding of Tocilizumab (MRA) to the IL-6R in the absence of the amino acid sequence, Nanobody, polypeptide and preferably biparatopic (or multiparatopic) polypeptide of the invention or the composition comprising the same.

In another aspect, the amino acid sequence, Nanobody, polypeptide and preferably biparatopic (or multiparatopic) polypeptide of the invention or the composition comprising the same will inhibit and/or block binding of IL-6 to IL-6R and binding of M182 to the IL-6R, preferably essentially simultaneously. The amino add sequence, Nanobody, polypeptide and preferably biparatopic (or multiparatopic) polypeptide of the invention or the composition comprising the same will preferably inhibit binding of IL-6 to IL-6R by at least 1%, preferably at least 5%, such as at least 10%, for example 25% or more or even 50% or more and up to 75% or even more than 90% or more, compared to binding of IL-6 to IL-6R in the absence of the amino acid sequence, Nanobody, polypeptide and preferably biparatopic (or multiparatopic) polypeptide of the invention or the composition comprising the same; and the amino acid sequence, Nanobody, polypeptide and preferably biparatopic (or multiparatopic) polypeptide of the invention or the composition comprising the same will preferably inhibit binding of M182 to IL-6R by at least 1%, preferably at least 5%, such as at least 10%, for example 25% or more or even 50% or more and up to 75% or even more than 90% or more, compared to binding of M182 to the IL-6R in the absence of the amino acid sequence, Nanobody, polypeptide and preferably biparatopic (or multiparatopic) polypeptide of the invention or the composition comprising the same.

In another aspect, the amino acid sequence, Nanobody, polypeptide and preferably biparatopic (or multiparatopic) polypeptide of the invention or the composition comprising the same will inhibit and/or block binding of IL-6 to IL-6R and binding of BN-12 to the IL-6R, preferably essentially simultaneously. The amino acid sequence, Nanobody, polypeptide and preferably biparatopic (or multiparatopic) polypeptide of the invention or the composition comprising the same will preferably inhibit binding of IL-6 to IL-6R by at least 1%, preferably at least 5%, such as at least 10%, for example 25% or more or even 50% or more and up to 75% or even more than 90% or more, compared to binding of IL-6 to IL-6R in the absence of the amino acid sequence, Nanobody, polypeptide and preferably biparatopic (or multiparatopic) polypeptide of the invention or the composition comprising the same; and the amino acid sequence, Nanobody, polypeptide and preferably biparatopic (or multiparatopic) polypeptide of the invention or the composition comprising the same will preferably inhibit binding of BN-12 to IL-6R by at least 1%, preferably at least 5%, such as at least 10%, for example 25% or more or even 50% or more and up to 75% or even more than 90% or more, compared to binding of BN-12 to the IL-6R in the absence of the amino acid sequence, Nanobody, polypeptide and preferably biparatopic (or multiparatopic) polypeptide of the invention or the composition comprising the same.

In another aspect, the amino acid sequence, Nanobody, polypeptide and preferably biparatopic (or multiparatopic) polypeptide of the invention or the composition comprising the same will inhibit and/or block binding of gp130 to the IL-6/IL-6R complex and binding of the reference IgG and/or reference Fab to IL-6R, preferably essentially simultaneously. The amino acid sequence, Nanobody, polypeptide and preferably biparatopic (or multiparatopic) polypeptide of the invention or the composition comprising the same will preferably inhibit binding of gp130 to the IL-6/IL-6R complex by at least 1%, preferably at least 5%, such as at least 10%, for example 25% or more or even 50% or more and up to 75% or even more than 90% or more, compared to binding of gp130 to the IL-6/IL-6R complex in the absence of the amino acid sequence, Nanobody, polypeptide and preferably biparatopic (or multiparatopic) polypeptide of the invention or the composition comprising the same; and the amino acid sequence, Nanobody, polypeptide and preferably biparatopic (or multiparatopic) polypeptide of the invention or the composition comprising the same will preferably inhibit binding of the reference IgG and/or Fab to IL-6R by at least 1%, preferably at least 5%, such as at least 10%, for example 25% or more or even 50% or more and up to 75% or even more than 90% or more, compared to binding of the reference IgG and/or Fab to IL-6R in the absence of the amino acid sequence, Nanobody, polypeptide and preferably biparatopic (or multiparatopic) polypeptide of the invention or the composition comprising the same.

In another aspect, the amino acid sequence, Nanobody, polypeptide and preferably biparatopic (or multiparatopic) polypeptide of the invention or the composition comprising the same will inhibit and/or block binding of gp130 to the IL-6/IL-6R complex and binding of Tocilizumab (MRA) to the IL-6R, preferably essentially simultaneously. The amino acid sequence, Nanobody, polypeptide and preferably biparatopic (or multiparatopic) polypeptide of the invention or the composition comprising the same will preferably inhibit binding of gp130 to the IL-6/IL-6R complex by at least 1%, preferably at least 5%, such as at least 10%, for example 25% or more or even 50% or more and up to 75% or even more than 90% or more, compared to binding of gp130 to the IL-6/IL-6R complex in the absence of the amino acid sequence, Nanobody, polypeptide and preferably biparatopic (or multiparatopic) polypeptide of the invention or the composition comprising the same; and the amino acid sequence, Nanobody, polypeptide and preferably biparatopic (or multiparatopic) polypeptide of the invention or the composition comprising the same will preferably inhibit binding of Tocilizumab (MRA) to IL-6R by at least 1%, preferably at least 5%, such as at least 10%, for example 25% or more or even 50% or more and up to 75% or even more than 90% or more, compared to binding of Tocilizumab (MRA) to the IL-6R in the absence of the amino acid sequence, Nanobody, polypeptide and preferably biparatopic (or multiparatopic) polypeptide of the invention or the composition comprising the same.

In another aspect, the amino acid sequence, Nanobody, polypeptide and preferably biparatopic (or multiparatopic) polypeptide of the invention or the composition comprising the same will inhibit and/or block binding of gp130 to the IL-6/IL-6R complex and binding of M182 to the IL-6R, preferably essentially simultaneously. The amino acid sequence, Nanobody, polypeptide and preferably biparatopic (or multiparatopic) polypeptide of the invention or the composition comprising the same will preferably inhibit binding of gp130 to the IL-6/IL-6R complex by at least 1%, preferably at least 5%, such as at least 10%, for example 25% or more or even 50% or more and up to 75% or even more than 90% or more, compared to binding of gp130 to the IL-6/IL-6R complex in the absence of the amino acid sequence, Nanobody, polypeptide and preferably biparatopic (or multiparatopic) polypeptide of the invention or the composition comprising the same; and the amino acid sequence, Nanobody, polypeptide and preferably biparatopic (or multiparatopic) polypeptide of the invention or the composition comprising the same will preferably inhibit binding of M182 to IL-6R by at least 1%, preferably at least 5%, such as at least 10%, for example 25% or more or even 50% or more and up to 75% or even more than 90% or more, compared to binding of M182 to the IL-6R in the absence of the amino acid sequence, Nanobody, polypeptide and preferably biparatopic (or multiparatopic) polypeptide of the invention or the composition comprising the same.

In another aspect, the amino acid sequence, Nanobody, polypeptide and preferably biparatopic (or multiparatopic) polypeptide of the invention or the composition comprising the same will inhibit and/or block binding of gp130 to the IL-6/IL-6R complex and binding of BN-12 to the IL-6R, preferably essentially simultaneously. The amino acid sequence, Nanobody, polypeptide and preferably biparatopic (or multiparatopic) polypeptide of the invention or the composition comprising the same will preferably inhibit binding of gp130 to the IL-6/IL-6R complex by at least 1%, preferably at least 5%, such as at least 10%, for example 25% or more or even 50% or more and up to 75% or even more than 90% or more, compared to binding of gp130 to the IL-6/IL-6R complex in the absence of the amino acid sequence, Nanobody, polypeptide and preferably biparatopic (or multiparatopic) polypeptide of the invention or the composition comprising the same; and the amino acid sequence, Nanobody, polypeptide and preferably biparatopic (or multiparatopic) polypeptide of the invention or the composition comprising the same will preferably inhibit binding of BN-12 to IL-6R by at least 1%, preferably at least 5%, such as at least 10%, for example 25% or more or even 50% or more and up to 75% or even more than 90% or more, compared to binding of BN-12 to the IL-6R in the absence of the amino acid sequence, Nanobody, polypeptide and preferably biparatopic (or multiparatopic) polypeptide of the invention or the composition comprising the same.

In another aspect, the amino acid sequence, Nanobody, polypeptide and preferably biparatopic (or multiparatopic) polypeptide of the invention or the composition comprising the same will inhibit and/or block binding of the reference IgG and/or the reference Fab to IL-6R and binding of Tocilizumab (MRA) to the IL-6R, preferably essentially simultaneously. The amino acid sequence, Nanobody, polypeptide and preferably biparatopic (or multiparatopic) polypeptide of the invention or the composition comprising the same will preferably inhibit binding of the reference IgG and/or the reference Fab to IL-6R by at least 1%, preferably at least 5%, such as at least 10%, for example 25% or more or even 50% or more and up to 75% or even more than 90% or more, compared to binding of the reference IgG and/or the reference Fab to IL-6R in the absence of the amino acid sequence, Nanobody, polypeptide and preferably biparatopic (or multiparatopic) polypeptide of the invention or the composition comprising the same; and the amino acid sequence, Nanobody, polypeptide and preferably biparatopic (or multiparatopic) polypeptide of the invention or the composition comprising the same will preferably inhibit binding of Tocilizumab (MRA) to IL-6R by at least 1%, preferably at least 5%, such as at least 10%, for example 25% or more or even 50% or more and up to 75% or even more than 90% or more, compared to binding of Tocilizumab (MRA) to the IL-6R in the absence of the amino acid sequence, Nanobody, polypeptide and preferably biparatopic (or multiparatopic) polypeptide of the invention or the composition comprising the same.

In another aspect, the amino acid sequence, Nanobody, polypeptide and preferably biparatopic (or multiparatopic) polypeptide of the invention or the composition comprising the same will inhibit and/or block binding of the reference IgG and/or the reference Fab to IL-6R and binding of M182 to the IL-6R, preferably essentially simultaneously. The amino acid sequence, Nanobody, polypeptide and preferably biparatopic (or multiparatopic) polypeptide of the invention or the composition comprising the same will preferably inhibit binding of the reference IgG and/or the reference Fab to IL-6R by at least 1%, preferably at least 5%, such as at least 10%, for example 25% or more or even 50% or more and up to 75% or even more than 90% or more, compared to binding of the reference IgG and/or the reference Fab to IL-6R in the absence of the amino acid sequence, Nanobody, polypeptide and preferably biparatopic (or multiparatopic) polypeptide of the invention or the composition comprising the same; and the amino acid sequence, Nanobody, polypeptide and preferably biparatopic (or multiparatopic) polypeptide of the invention or the composition comprising the same will preferably inhibit binding of M182 to IL-6R by at least 1%, preferably at least 5%, such as at least 10%, for example 25% or more or even 50% or more and up to 75% or even more than 90% or more, compared to binding of M182 to the IL-6R in the absence of the amino acid sequence, Nanobody, polypeptide and preferably biparatopic (or multiparatopic) polypeptide of the invention or the composition comprising the same.

In another aspect, the amino acid sequence, Nanobody, polypeptide and preferably biparatopic (or multiparatopic) polypeptide of the invention or the composition comprising the same will inhibit and/or block binding of the reference IgG and/or the reference Fab to IL-6R and binding of BN-12 to the IL-6R, preferably essentially simultaneously. The amino acid sequence, Nanobody, polypeptide and preferably biparatopic (or multiparatopic) polypeptide of the invention or the composition comprising the same will preferably inhibit binding of the reference IgG and/or the reference Fab to IL-6R by at least 1%, preferably at least 5%, such as at least 10%, for example 25% or more or even 50% or more and up to 75% or even more than 90% or more, compared to binding of the reference IgG and/or the reference Fab to IL-6R in the absence of the amino acid sequence, Nanobody, polypeptide and preferably biparatopic (or multiparatopic) polypeptide of the invention or the composition comprising the same; and the amino acid sequence, Nanobody, polypeptide and preferably biparatopic (or multiparatopic) polypeptide of the invention or the composition comprising the same will preferably inhibit binding of BN-12 to IL-6R by at least 1%, preferably at least 5%, such as at least 10%, for example 25% or more or even 50% or more and up to 75% or even more than 90% or more, compared to binding of BN-12 to the IL-6R in the absence of the amino acid sequence, Nanobody, polypeptide and preferably biparatopic (or multiparatopic) polypeptide of the invention or the composition comprising the same.

In another aspect, the amino acid sequence, Nanobody, polypeptide and preferably biparatopic (or multiparatopic) polypeptide of the invention or the composition comprising the same will inhibit and/or block binding of Tocilizumab (MRA) to IL-6R and binding of M182 to the IL-6R, preferably essentially simultaneously. The amino acid sequence, Nanobody, polypeptide and preferably biparatopic (or multiparatopic) polypeptide of the invention or the composition comprising the same will preferably inhibit binding of Tocilizumab (MRA) to IL-6R by at least 1%, preferably at least 5%, such as at least 10%, for example 25% or more or even 50% or more and up to 75% or even more than 90% or more, compared to binding of Tocilizumab (MRA) to IL-6R in the absence of the amino acid sequence, Nanobody, polypeptide and preferably biparatopic (or multiparatopic) polypeptide of the invention or the composition comprising the same; and the amino acid sequence, Nanobody, polypeptide and preferably biparatopic (or multiparatopic) polypeptide of the invention or the composition comprising the same will preferably inhibit binding of M182 to IL-6R by at least 1%, preferably at least 5%, such as at least 10%, for example 25% or more or even 50% or more and up to 75% or even more than 90% or more, compared to binding of M182 to the IL-6R in the absence of the amino acid sequence, Nanobody, polypeptide and preferably biparatopic (or multiparatopic) polypeptide of the invention or the composition comprising the same.

In another aspect, the amino acid sequence, Nanobody, polypeptide and preferably biparatopic (or multiparatopic)

polypeptide of the invention or the composition comprising the same will inhibit and/or block binding of Tocilizumab (MRA) to IL-6R and binding of BN-12 to IL-6R, preferably essentially simultaneously. The amino acid sequence, Nanobody, polypeptide and preferably biparatopic (or multiparatopic) polypeptide of the invention or the composition comprising the same will preferably inhibit binding of Tocilizumab (MRA) to IL-6R by at least 1%, preferably at least 5%, such as at least 10%, for example 25% or more or even 50% or more and up to 75% or even more than 90% or more, compared to binding of Tocilizumab (MRA) to IL-6R in the absence of the amino acid sequence, Nanobody, polypeptide and preferably biparatopic (or multiparatopic) polypeptide of the invention or the composition comprising the same; and the amino acid sequence, Nanobody, polypeptide and preferably biparatopic (or multiparatopic) polypeptide of the invention or the composition comprising the same will preferably inhibit binding of BN-12 to IL-6R by at least 1%, preferably at least 5%, such as at least 10%, for example 25% or more or even 50% or more and up to 75% or even more than 90% or more, compared to binding of BN-12 to the IL-6R in the absence of the amino acid sequence, Nanobody, polypeptide and preferably biparatopic (or multiparatopic) polypeptide of the invention or the composition comprising the same.

In another aspect, the amino acid sequence, Nanobody, polypeptide and preferably biparatopic (or multiparatopic) polypeptide of the invention or the composition comprising the same will inhibit and/or block binding of BN-12 to IL-6R and binding of M182 to the IL-6R, preferably essentially simultaneously. The amino acid sequence, Nanobody, polypeptide and preferably biparatopic (or multiparatopic) polypeptide of the invention or the composition comprising the same will preferably inhibit binding of BN-12 to IL-6R by at least 1%, preferably at least 5%, such as at least 10%, for example 25% or more or even 50% or more and up to 75% or even more than 90% or more, compared to binding of BN-12 to IL-6R in the absence of the amino acid sequence, Nanobody, polypeptide and preferably biparatopic (or multiparatopic) polypeptide of the invention or the composition comprising the same; and the amino acid sequence, Nanobody, polypeptide and preferably biparatopic (or multiparatopic) polypeptide of the invention or the composition comprising the same will preferably inhibit binding of M182 to IL-6R by at least 1%, preferably at least 5%, such as at least 10%, for example 25% or more or even 50% or more and up to 75% or even more than 90% or more, compared to binding of M182 to the IL-6R in the absence of the amino acid sequence, Nanobody, polypeptide and preferably biparatopic (or multiparatopic) polypeptide of the invention or the composition comprising the same.

In another aspect, the amino acid sequence, Nanobody, polypeptide and preferably biparatopic (or multiparatopic) polypeptide of the invention or the composition comprising the same is an antagonist of IL-6R and will inhibit, decrease, downregulate and/or block signalling mediated by IL-6, IL-6R, the IL-6/IL-6R complex and/or gp130 and/or the pathway(s) and/or mechanism(s) in which
IL-6, IL-6R, the IL-6/IL-6R complex or gp130 are involved. The amino acid sequence, Nanobody, polypeptide and preferably biparatopic (or multiparatopic) polypeptide of the invention or the composition comprising the same will preferably inhibit, decrease, downregulate and/or block signalling of IL-6, IL-6R, the IL-6/IL-6R complex and/or gp130 and/or the pathway(s) and/or mechanism(s) in which IL-6, IL-6R, the IL-6/IL-6R complex or gp130 are involved by at least 1%, preferably at least 5%, such as at least 10%, for example 25% or more or even 50% or more and up to 75% or even more than 90% or more, compared to signalling mediated by IL-6, IL-6R, the IL-6/IL-6R complex and/or gp130 and/or the pathway(s) and/or mechanism(s) in which IL-6, IL-6R, the IL-6/IL-6R complex or gp130 are involved in the absence of the amino acid sequence, Nanobody, polypeptide and preferably biparatopic (or multiparatopic) polypeptide of the invention or the composition comprising the same. In a preferred aspect, the amino acid sequence, Nanobody, polypeptide and preferably biparatopic (or multiparatopic) polypeptide of the invention or the composition comprising the same will inhibit, decrease, downregulate and/or block signalling mediated by IL-6, IL-6R, the IL-6/IL-6R complex and/or gp130 and/or the pathway(s) and/or mechanism(s) in which IL-6, IL-6R, the IL-6/IL-6R complex or gp130 are involved equally or better than the reference IgG and/or the reference Fab. In another preferred aspect, the amino acid sequence, Nanobody, polypeptide and preferably biparatopic (or multiparatopic) polypeptide of the invention or the composition comprising the same will inhibit, decrease, downregulate and/or block signalling mediated by IL-6, IL-6R, the IL-6/IL-6R complex and/or gp130 and/or the pathway(s) and/or mechanism(s) in which IL-6, IL-6R, the IL-6/IL-6R complex or gp130 are involved equally or better than Tocilizumab (MRA). In another preferred aspect, the amino acid sequence, Nanobody, polypeptide and preferably biparatopic (or multiparatopic) polypeptide of the invention or the composition comprising the same will inhibit, decrease, downregulate and/or block signalling mediated by IL-6, IL-6R, the IL-6/IL-6R complex and/or gp130 and/or the pathway(s) and/or mechanism(s) in which IL-6, IL-6R, the IL-6/IL-6R complex or gp130 are involved equally or better than M182. In another preferred aspect, the amino acid sequence, Nanobody, polypeptide and preferably biparatopic (or multiparatopic) polypeptide of the invention or the composition comprising the same will inhibit, decrease, downregulate and/or block signalling mediated by IL-6, IL-6R, the IL-6/IL-6R complex and/or gp130 and/or the pathway(s) and/or mechanism(s) in which IL-6, IL-6R, the IL-6/IL-6R complex or gp130 are involved equally or better than Tocilizumab (MRA) and M182. In another preferred aspect, the amino acid sequence, Nanobody, polypeptide and preferably biparatopic (or multiparatopic) polypeptide of the invention or the composition comprising the same will inhibit, decrease, downregulate and/or block signalling mediated by IL-6, IL-6R, the IL-6/IL-6R complex and/or gp130 and/or the pathway(s) and/or mechanism(s) in which IL-6, IL-6R, the IL-6/IL-6R complex or gp130 are involved equally or better than the reference IgG and/or the reference Fab and than M182. In a preferred, but non-limiting aspect, a suitable antagonistic biparatopic (or multiparatopic) polypeptide of the invention is used, and more preferably one of the preferred biparatopic (or multiparatopic) polypeptides of the invention is used, as further described herein.

The amino acid sequences, Nanobodies, polypeptide and preferably biparatopic (or multiparatopic) polypeptides and compositions of the invention are also preferably (but without limitation) such that they effect a decrease (i.e. by at least 1 percent such as by at least 10 percent, preferably by at least 30 percent, more preferably by at least 50 percent, even more preferably by at least 75 percent or more) or a total inhibition of the induction of C-reactive protein (CRP) in a mammal (such as in a human subject or in a suitable animal model for inflammation such as the a cynomologus monkey) when they are administered to said mammal in a therapeutically relevant amount compared to a mammal not receiving the amino acid sequence, Nanobody, polypeptide and preferably biparatopic (or multiparatopic) polypeptide, compound or composition of the invention. Preferably, the amino acid sequences, Nanobodies, polypeptides and preferably biparatopic (or multiparatopic) polypeptides and compositions comprising the same are (but without limitation) such that they effect a decrease of the induction of C-reactive protein (CRP) in a mammal (such as in a human subject or in a suitable animal model for inflammation such as the a cynomologus monkey) that is the same or better (at least 5%, preferably at least 10%, more preferably at least 20%, even more preferably at least 30% or more, such as at least 50% or more) compared to the decrease effected by the reference IgG and/or the reference Fab when administered to said mammal in a therapeutically relevant amount. Preferably, the amino acid sequences, Nanobodies, polypeptides and preferably biparatopic (or multiparatopic) polypeptides and compositions comprising the same are (but without limitation) such that they effect a decrease of the induction of C-reactive protein (CRP) in a mammal (such as in a human subject or in a suitable animal model for inflammation such as the cynomologus monkey) that is the same or better (at least 5%, preferably at least 10%, more preferably at least 20%, even more preferably at least 30% or more, such as at least 50% or more) compared to the decrease effected by Tocilizumab (MRA) when administered to said mammal in a therapeutically relevant amount. Preferably, the amino acid sequences, Nanobodies, polypeptides and preferably biparatopic (or multiparatopic) polypeptides and compositions comprising the same are (but without limitation) such that they effect a decrease of the induction of C-reactive protein (CRP) in a mammal (such as in a human subject or in a suitable animal model for inflammation such as the a cynomologus monkey) that is the same or better (at least 5%, preferably at least 10%, more preferably at least 20%, even more preferably at least 30% or more, such as at least 50% or more) compared to the decrease effected by M182 when administered to said mammal in a therapeutically relevant amount.

The amino acid sequences, Nanobodies, polypeptides and preferably biparatopic (or multiparatopic) polypeptides and compositions comprising the same are also preferably (but without limitation) such that they effect a decrease (i.e. by at least 1 percent such as by at least 10 percent, preferably by at least 30 percent, more preferably by at least 50 percent, even more preferably by at least 75 percent or more) or a total inhibition of the induction of the platelet count in a mammal (such as in a human subject or in a suitable animal model for inflammation such as the a cynomologus monkey) when they are administered to said mammal in a therapeutically relevant amount compared to a mammal not receiving the amino acid sequence, Nanobody, polypeptide and preferably biparatopic (or multiparatopic) polypeptide or compositions comprising the same. Preferably, the amino acid sequences, Nanobodies, polypeptides and preferably biparatopic (or multiparatopic) polypeptides and compositions comprising the same are (but without limitation) such that they effect a decrease of the induction of the platelet count in a mammal (such as in a human subject or in a suitable animal model for inflammation such as the a cynomologus monkey) that is the same or better (at least 5%, preferably at least 10%, more preferably at least 20%, even more preferably at least 30% or more, such as at least 50% or more) compared to the decrease effected by the reference IgG and/or the reference Fab when administered to said mammal in a therapeutically relevant amount. Preferably, the amino acid sequences, Nanobodies, polypeptides and preferably biparatopic (or multiparatopic) polypeptides and compositions comprising the same are (but without limitation) such that they effect a decrease of the induction of the platelet count in a mammal (such as in a human subject or in a suitable animal model for inflammation such as the a cynomologus monkey) that is the same or better (at least 5%, preferably at least 10%, more preferably at least 20%, even more preferably at least 30% or more, such as at least 50% or more) compared to the decrease effected by Tocilizumab (MRA) when administered to said mammal in a therapeutically relevant amount. Preferably, the amino acid sequences, Nanobodies, polypeptides and preferably biparatopic (or multiparatopic) polypeptides and compositions comprising the same are (but without limitation) such that they effect a decrease of the induction of the platelet count in a mammal (such as in a human subject or in a suitable animal model for inflammation such as the a cynomologus monkey) that is the same or better (at least 5%, preferably at least 10%, more preferably at least 20%, even more preferably at least 30% or more, such as at least 50% or more) compared to the decrease effected by M182 when administered to said mammal in a therapeutically relevant amount.

The amino acid sequences, Nanobodies, polypeptides and preferably biparatopic (or multiparatopic) polypeptides and compositions comprising the same are also preferably (but without limitation) such that they effect a decrease (i.e. by at least 1 percent such as by at least 10 percent, preferably by at least 30 percent, more preferably by at least 50 percent, even more preferably by at least 75 percent or more) or a total inhibition of the induction of fibrinogen in a mammal (such as in a human subject or in a suitable animal model for inflammation such as the cynomologus monkey) when they are administered to said mammal in a therapeutically relevant amount compared to a mammal not receiving the amino acid sequence, Nanobody, polypeptide and preferably biparatopic (or multiparatopic) polypeptide or compositions comprising the same. Preferably, the amino acid sequences, Nanobodies, polypeptides and preferably biparatopic (or multiparatopic) polypeptides and compositions comprising the same are (but without limitation) such that they effect a decrease of the induction of fibrinogen in a mammal (such as in a human subject or in a suitable animal model for inflammation such as the a cynomologus monkey) that is the same or better (at least 5%, preferably at least 10%, more preferably at least 20%, even more preferably at least 30% or more, such as at least 50% or more) compared to the decrease effected by the reference IgG and/or the reference Fab when administered to said mammal in a therapeutically relevant amount. Preferably, the amino acid sequences, Nanobodies, polypeptides and preferably biparatopic (or multiparatopic) polypeptides and compositions comprising the same are (but without limitation) such that they effect a decrease of the induction of fibrinogen in a mammal (such as in a human subject or in a suitable animal model for inflammation such as the a cynomologus monkey) that is the same or better (at least 5%, preferably at least 10%, more preferably at least 20%, even more preferably at least 30% or more, such as at least 50% or more) compared to the decrease effected by Tocilizumab (MRA) when administered to said mammal in a therapeutically relevant amount. Preferably, the amino acid sequences, Nanobodies, polypeptides and preferably biparatopic (or multiparatopic) polypeptides and compositions comprising the same are (but without limitation) such that they effect a decrease of the induction of the fibrinogen in a mammal (such as in a human subject or in a suitable animal model for inflammation such as the a cynomologus monkey) that is the same or better (at least 5%, preferably at least 10%, more preferably at least 20%, even more preferably at least 30% or more, such as at least 50% or more) compared to the decrease effected by M182 when administered to said mammal in a therapeutically relevant amount.

As such, the amino acid sequences, Nanobodies, compounds, constructs, polypeptides, and preferably biparatopic (or multiparatopic) polypeptides, and compositions of the invention can be used for the prevention and treatment of diseases and disorders associated with IL-6R, IL-6 and/or with the IL-6/IL-6R complex (optionally in further complex with gp130), and/or with the signaling pathway(s) and/or the biological functions and responses in which IL-6 and/or the IL-6/IL-6R complex (optionally in further complex with gp130) are involved, and in particular for the prevention and treatment of diseases and disorders associated with IL-6R, IL-6 and/or with the IL-6/IL-6R complex (optionally in further complex with gp130), and/or with the signaling pathway(s) and/or the biological functions and responses in which IL-6R, IL-6 and/or with the IL-6/IL-6R complex (optionally in further complex with gp130) are involved, which are characterized by excessive and/or unwanted signalling mediated by IL-6R or by the pathway(s) in which IL-6R is involved. Examples of such diseases and disorders associated with IL-6R, IL-6 and/or with the IL-6/IL-6R complex, and/or with the signaling pathway(s) and/or the biological functions and responses in which IL-6 and/or the IL-6/IL-6R complex are involved, will be clear to the skilled person based on the disclosure herein, and for example include the following diseases and disorders: sepsis (Starnes et al., 1999) and various forms of cancer such as multiple myeloma disease (MM), renal cell carcinoma (RCC), plasma cell leukaemia (Klein et al., 1991), lymphoma, B-lymphoproliferative disorder (BLPD) and prostate cancer. Non-limiting examples of other diseases caused by excessive IL-6 production or signalling include bone resorption (osteoporosis) (Roodman et al., 1992; Jilka et al., 1992), cachexia (Strassman et al., 1992), psoriasis, mesangial proliferative glomerulonephritis, Kaposi's sarcoma, AIDS-related lymphoma (Emilie et al., 1994), inflammatory diseases and disorder such as rheumatoid arthritis, systemic onset juvenile idiopathic arthritis, hypergammaglobulinemia (Grau et al., 1990); Crohn's disease, ulcerative colitis, systemic lupus erythematosus (SLE), multiple sclerosis, Castleman's disease, IgM gammopathy, cardiac myxoma, asthma (in particular allergic asthma) and autoimmune insulin-dependent diabetes mellitus (Campbell et al., 1991). Other IL-6R, IL-6 and/or IL-6/IL-6R complex related disorders will be clear to the skilled person. Such diseases and disorders are also generally referred to herein as "IL-6R related disorders".

Thus, without being limited thereto, the amino acid sequences, Nanobodies, compounds, constructs, polypeptides, and preferably biparatopic (or multiparatopic) polypeptides, and compositions of the invention can for example be used to prevent and/or to treat all diseases and disorders that are currently being prevented or treated with active principles that can modulate IL-6R-mediated signalling, such as those mentioned in the prior art cited above. It is also envisaged that the polypeptides of the invention can be used to prevent and/or to treat all diseases and disorders for which treatment with such active principles is currently being developed, has been proposed, or will be proposed or developed in future. In addition, it is envisaged that, because of their favourable properties as further described herein, the polypeptides of the present invention may be used for the prevention and treatment of other diseases and disorders than those for which these known active principles are being used or will be proposed or developed; and/or that the polypeptides of the present invention may provide new methods and regimens for treating the diseases and disorders described herein.

Other applications and uses of the amino acid sequences, Nanobodies, compounds, constructs, polypeptides, and preferably biparatopic (or multiparatopic) polypeptides, and compositions of the invention will become clear to the skilled person from the further disclosure herein.

Generally, it is an object of the invention to provide pharmacologically active agents, as well as compositions comprising the same, that can be used in the diagnosis, prevention and/or treatment of one or more IL-6R related disorders (as defined herein); and to provide methods for the diagnosis, prevention and/or treatment of such diseases and disorders that involve the administration and/or use of such agents and compositions.

More in particular, it is an object of the invention to provide therapeutic proteins that can be used as pharmacologically active agents, as well as compositions comprising the same, for the diagnosis, prevention and/or treatment of one or more IL-6R related disorders (as defined herein); and to provide methods for the diagnosis, prevention and/or treatment of such diseases and disorders that involve the administration and/or the use of such therapeutic proteins and compositions.

Accordingly, it is a specific object of the present invention to provide amino acid sequences, Nanobodies, compounds, constructs, polypeptides, and preferably biparatopic (or multiparatopic) polypeptides that are directed against (as defined herein) IL-6R, in particular against IL-6R from a warm-blooded animal, more in particular against IL-6R from a mammal, and especially against human IL-6R; and to provide proteins and polypeptides comprising or essentially consisting of at least one such amino acid sequence, Nanobody, compound, construct, polypeptide, or preferably biparatopic (or multiparatopic) polypeptide.

In particular, it is a specific object of the present invention to provide such amino acid sequences, Nanobodies, compounds, constructs, polypeptides, and preferably biparatopic (or multiparatopic) polypeptides and such proteins and/or polypeptides that are suitable for prophylactic, therapeutic and/or diagnostic use in a warm-blooded animal, and in particular in a mammal, and more in particular in a human being.

More in particular, it is a specific object of the present invention to provide such amino acid sequences, Nanobodies, compounds, constructs, polypeptides, and preferably biparatopic (or multiparatopic) polypeptides and such proteins and/or polypeptides that can be used for the prevention, treatment, alleviation and/or diagnosis of one or more IL-6R related disorders (as defined herein) in a warm-blooded animal, in particular in a mammal, and more in particular in a human being.

It is also a specific object of the invention to provide such amino acid sequences, Nanobodies, compounds, constructs, polypeptides, and preferably biparatopic (or multiparatopic) polypeptides and such proteins and/or polypeptides that can be used in the preparation of pharmaceutical or veterinary compositions for the prevention and/or treatment of one or more IL-6R related disorders (as defined herein) in a warm-blooded animal, in particular in a mammal, and more in particular in a human being.

In the invention, generally, these objects are achieved by the use of the amino acid sequences, Nanobodies, compounds, constructs, polypeptides, and preferably biparatopic (or multiparatopic) polypeptides, and compositions that are described herein.

Generally, when an amino acid sequence (Nanobody, compound, construct, polypeptide, and preferably biparatopic (or multiparatopic) polypeptide, and composition comprising the same) is P5 intended for administration to a subject (for example for therapeutic and/or diagnostic purposes as described herein), it is preferably either an amino acid sequence that does not occur naturally in said subject; or, when it does occur naturally in said subject, in essentially isolated form (as defined herein).

It will also be clear to the skilled person that for pharmaceutical use, the amino acid sequences and/or Nanobodies of the invention (as well as compounds, constructs, polypeptides and preferably biparatopic (or multiparatopic) polypeptides comprising the same) are preferably directed against human IL-6R; whereas for veterinary purposes, the amino acid sequences and/or Nanobodies (as well as compounds, constructs, polypeptides and preferably biparatopic (or multiparatopic) polypeptides comprising the same) are preferably directed against IL-6R from the species to be treated, or at least cross-reactive with IL-6R from the species to be treated.

The efficacy of the amino acid sequences, Nanobodies, compounds, constructs, polypeptides, and preferably biparatopic (or multiparatopic) polypeptides, and compositions comprising the same, can be tested using any suitable in vitro assay, cell-based assay, in vivo assay and/or animal model known per se, or any combination thereof, depending on the specific disease or disorder involved. Suitable assays and animal models will be clear to the skilled person, and for example include proliferation assays using IL6-dependent cell lines including B9, XG1 and 7TD1, TF-1 assay as described by Kitamura et al. (1989, J. Cell Physiol. 140: 323), collagen induced arthritis model, transplant model of synovial tissue in SCID mice, xenograft models of various human cancers, including lymphoma, myeloma, prostate cancer and renal cell carcinoma, IBD models including TNBS, DSS and IL10 knockout models, primate models (such as e.g. described in Shinkura et al. 1998, Anticancer Research 18: 1217-1222), non-human primate models of arthritic disease (as e.g described in Vierboom et al., 2008, Drug Discov. Today: Dis Model doi:10.1016/j.ddmod.2008.06.003) as well as the assays and animal models used in the experimental part below and in the prior art cited herein (Peake et al., Rheumatology 2006; 45(12):1485-9; Wahid et al.; Clin Exp Immunol. 2000, 122:133-142; Matsuno et al., Arthritis and rheumatism, 1998, 41: 2014-2021).

For example, in the TF-1 assay as described by Kitamura et al. (1989, J. Cell Physiol. 140: 323), the amino acid sequences, Nanobodies and/or polypeptides of the invention and/or the compositions comprising the same may have IC50 values (at 100 IU/mL IL-6) between 10 nM and 50 µM, preferably between 5 nM and 50 µM, more preferably between 1 nM and 50 µM or less, such as about 750 or 500 µM or less. In this TF-1 assay the amino acid sequences, Nanobodies and/or polypeptides of the invention and/or the compositions comprising the same may have IC50 values (at 5000 IU/mL IL-6) between 50 nM and 1 nM, preferably between 25 nM and 1 nM, more preferably between 10 nM and 1 nM or less, such as about 8 nM or less. In this TF-1 assay, the amino acid sequences, Nanobodies and/or polypeptides of the invention and/or the compositions comprising the same may have IC50 values that are at least the same and preferably better or lower, at least two times, preferably three times, more preferably four times, even more preferably 5 times, 7 times or more than 7 times better or lower compared to the IC50 value obtained for the reference IgG as defined by SEQ ID NO's: 126 and 127 or the reference Fab as defined by SEQ ID NO's: 128 and 129 (see Example 1). In this TF-1 assay, the amino acid sequences, Nanobodies and/or polypeptides of the invention and/or the compositions comprising the same may have IC50 values that are at least the same and preferably better or lower, at least two times, preferably three times, more preferably four times, even more preferably 5 times, 7 times or more than 7 times better or lower compared to the IC50 value obtained for Tocilizumab (MRA).

In another aspect, the invention relates to a method for the prevention and/or treatment of at least one IL-6R related disease or disorder, said method comprising administering, to a subject in need thereof, a pharmaceutically active amount of an amino acid sequence of the invention, of a Nanobody of the invention, of a polypeptide of the invention, and/or of a pharmaceutical composition comprising the same.

In the context of the present invention, the term "prevention and/or treatment" not only comprises preventing and/or treating the disease, but also generally comprises preventing the onset of the disease, slowing or reversing the progress of disease, preventing or slowing the onset of one or more symptoms associated with the disease, reducing and/or alleviating one or more symptoms associated with the disease, reducing the severity and/or the duration of the disease and/or of any symptoms associated therewith and/or preventing a further increase in the severity of the disease and/or of any symptoms associated therewith, preventing, reducing or reversing any physiological damage caused by the disease, and generally any pharmacological action that is beneficial to the patient being treated.

The subject to be treated may be any warm-blooded animal, but is in particular a mammal, and more in particular a human being. As will be clear to the skilled person, the subject to be treated will in particular be a person suffering from, or at risk of, the diseases and disorders mentioned herein.

The invention relates to a method for the prevention and/or treatment of at least one disease or disorder that is associated with IL-6R, with its biological or pharmacological activity, and/or with the biological pathways or signalling in which IL-6R is involved, said method comprising administering, to a subject in need thereof, a pharmaceutically active amount of an amino acid sequence of the invention, of a Nanobody of the invention, of a polypeptide of the invention, and/or of a pharmaceutical composition comprising the same. In particular, the invention relates to a method for the prevention and/or treatment of at least one disease or disorder that can be treated by modulating IL-6R, its biological or pharmacological activity, and/or the biological pathways or signalling in which IL-6R is involved, said method comprising administering, to a subject in need thereof, a pharmaceutically active amount of an amino acid sequence of the invention, of a Nanobody of the invention, of a polypeptide of the invention, and/or of a pharmaceutical composition comprising the same. In particular, said pharmaceutically effective amount may be an amount that is sufficient to modulate IL-6R, its biological or pharmacological activity, and/or the biological pathways or signalling in which IL-6R is involved; and/or an amount that provides a level of the amino acid sequence of the invention, of a Nanobody of the invention, of a polypeptide of the invention in the circulation that is sufficient to modulate IL-6R, its biological or pharmacological activity, and/or the biological pathways or signalling in which IL-6R is involved.

The invention furthermore relates to a method for the prevention and/or treatment of at least one disease or disorder that can be prevented and/or treated by administering an amino acid sequence of the invention, a Nanobody of the invention or a polypeptide of the invention to a patient, said method comprising administering, to a subject in need thereof, a pharmaceutically active amount of an amino acid sequence of the invention, of a Nanobody of the invention, of a polypeptide of the invention, and/or of a pharmaceutical composition comprising the same.

More in particular, the invention relates to a method for the prevention and/or treatment of at least one disease or disorder chosen from the group consisting of the diseases and disorders listed herein, said method comprising administering, to a subject in need thereof, a pharmaceutically active amount of an amino acid sequence of the invention, of a Nanobody of the invention, of a polypeptide of the invention, and/or of a pharmaceutical composition comprising the same.

In another aspect, the invention relates to a method for immunotherapy, and in particular for passive immunotherapy, which method comprises administering, to a subject suffering from or at risk of the diseases and disorders mentioned herein, a pharmaceutically active amount of an amino acid sequence of the invention, of a Nanobody of the invention, of a polypeptide of the invention, and/or of a pharmaceutical composition comprising the same.

In the above methods, the amino acid sequences, Nanobodies and/or polypeptides of the invention and/or the compositions comprising the same can be administered in any suitable manner, depending on the specific pharmaceutical formulation or composition to be used. Thus, the amino acid sequences, Nanobodies and/or polypeptides of the invention and/or the compositions comprising the same can for example be administered orally, intraperitoneally (e.g. intravenously, subcutaneously, intramuscularly, or via any other route of administration that circumvents the gastrointestinal tract), intranasally, transdermally, topically, by means of a suppository, by inhalation, again depending on the specific pharmaceutical formulation or composition to be used. The clinician will be able to select a suitable route of administration and a suitable pharmaceutical formulation or composition to be used in such administration, depending on the disease or disorder to be prevented or treated and other factors well known to the clinician.

The amino acid sequences, Nanobodies and/or polypeptides of the invention and/or the compositions comprising the same are administered according to a regime of treatment that is suitable for preventing and/or treating the disease or disorder to be prevented or treated. The clinician will generally be able to determine a suitable treatment regimen, depending on factors such as the disease or disorder to be prevented or treated, the severity of the disease to be treated and/or the severity of the symptoms thereof, the specific amino acid sequence, Nanobody or polypeptide of the invention to be used, the specific route of administration and pharmaceutical formulation or composition to be used, the age, gender, weight, diet, general condition of the patient, and similar factors well known to the clinician.

Generally, the treatment regimen will comprise the administration of one or more amino acid sequences, Nanobodies and/or polypeptides of the invention, or of one or more compositions comprising the same, in one or more pharmaceutically effective amounts or doses. The specific amount(s) or doses to administered can be determined by the clinician, again based on the factors cited above.

Generally, for the prevention and/or treatment of the diseases and disorders mentioned herein and depending on the specific disease or disorder to be treated, the potency of the specific amino acid sequence, Nanobody and polypeptide of the invention to be used, the specific route of administration and the specific pharmaceutical formulation or composition used, the amino acid sequences, Nanobodies and polypeptides of the invention will generally be administered in an amount between 1 gram and 0.01 microgram per kg body weight per day, preferably between 0.1 gram and 0.1 microgram per kg body weight per day, such as about 1, 10, 100 or 1000 microgram per kg body weight per day, either continuously (e.g. by infusion), as a single daily dose or as multiple divided doses during the day. The clinician will generally be able to determine a suitable daily dose, depending on the factors mentioned herein. It will also be clear that in specific cases, the clinician may choose to deviate from these amounts, for example on the basis of the factors cited above and his expert judgment. Generally, some guidance on the amounts to be administered can be obtained from the amounts usually administered for comparable conventional antibodies or antibody fragments against the same target administered via essentially the same route, taking into account however differences in affinity/avidity, efficacy, biodistribution, half-life and similar factors well known to the skilled person.

Usually, in the above method, a single amino acid sequence, Nanobody or polypeptide of the invention will be used. It is however within the scope of the invention to use two or more amino acid sequences, Nanobodies and/or polypeptides of the invention in combination.

The Nanobodies, amino acid sequences and polypeptides of the invention may also be used in combination with one or more further pharmaceutically active compounds or principles, i.e. as a combined treatment regimen, which may or may not lead to a synergistic effect. Again, the clinician will be able to select such further compounds or principles, as well as a suitable combined treatment regimen, based on the factors cited above and his expert judgement.

In particular, the amino acid sequences, Nanobodies and polypeptides of the invention may be used in combination with other pharmaceutically active compounds or principles that are or can be used for the prevention and/or treatment of the diseases and disorders cited herein, as a result of which a synergistic effect may or may not be obtained. Examples of such compounds and principles, as well as routes, methods and pharmaceutical formulations or compositions for administering them will be clear to the clinician.

When two or more substances or principles are to be used as part of a combined treatment regimen, they can be administered via the same route of administration or via different routes of administration, at essentially the same time or at different times (e.g. essentially simultaneously, consecutively, or according to an alternating regime). When the substances or principles are to be administered simultaneously via the same route of administration, they may be administered as different pharmaceutical formulations or compositions or part of a combined pharmaceutical formulation or composition, as will be clear to the skilled person.

Also, when two or more active substances or principles are to be used as part of a combined treatment regimen, each of the substances or principles may be administered in the same amount and according to the same regimen as used when the compound or principle is used on its own, and such combined use may or may not lead to a synergistic effect. However, when the combined use of the two or more active substances or principles leads to a synergistic effect, it may also be possible to reduce the amount of one, more or all of the substances or principles to be administered, while still achieving the desired therapeutic action. This may for example be useful for avoiding, limiting or reducing any unwanted side-effects that are associated with the use of one or more of the substances or principles when they are used in their usual amounts, while still obtaining the desired pharmaceutical or therapeutic effect.

The effectiveness of the treatment regimen used according to the invention may be determined and/or followed in any manner known per se for the disease or disorder involved, as will be clear to the clinician. The clinician will also be able, where appropriate and on a ease-by-case basis, to change or modify a particular treatment regimen, so as to achieve the desired therapeutic effect, to avoid, limit or reduce unwanted side-effects, and/or to achieve an appropriate balance between achieving the desired therapeutic effect on the one hand and avoiding, limiting or reducing undesired side effects on the other hand.

Generally, the treatment regimen will be followed until the desired therapeutic effect is achieved and/or for as long as the desired therapeutic effect is to be maintained. Again, this can be determined by the clinician.

In another aspect, the invention relates to the use of an amino acid sequence, Nanobody or polypeptide of the invention in the preparation of a pharmaceutical composition for prevention and/or treatment of at least one IL-6R related disease or disorder; and/or for use in one or more of the methods of treatment mentioned herein.

The subject to be treated may be any warm-blooded animal, but is in particular a mammal, and more in particular a human being. As will be clear to the skilled person, the subject to be treated will in particular be a person suffering from, or at risk of, the diseases and disorders mentioned herein.

The invention also relates to the use of an amino acid sequence, Nanobody or polypeptide of the invention in the preparation of a pharmaceutical composition for the prevention and/or treatment of at least one disease or disorder that can be prevented and/or treated by administering an amino acid sequence, Nanobody or polypeptide of the invention to a patient.

More in particular, the invention relates to the use of an amino acid sequence, Nanobody or polypeptide of the invention in the preparation of a pharmaceutical composition for the prevention and/or treatment of an IL-6R related disease or disorder, and in particular for the prevention and treatment of one or more of the diseases and disorders listed herein.

Again, in such a pharmaceutical composition, the one or more amino acid sequences, Nanobodies or polypeptides of the invention may also be suitably combined with one or more other active principles, such as those mentioned herein.

Finally, although the use of the Nanobodies of the invention (as defined herein) and of the polypeptides of the invention is much preferred, it will be clear that on the basis of the description herein, the skilled person will also be able to design and/or generate, in an analogous manner, other amino acid sequences and in particular (single) domain antibodies against IL-6R, as well as polypeptides comprising such (single) domain antibodies.

For example, it will also be clear to the skilled person that it may be possible to "graft" one or more of the CDR's mentioned above for the Nanobodies of the invention onto such (single) domain antibodies or other protein scaffolds, including but not limited to human scaffolds or non-immunoglobulin scaffolds. Suitable scaffolds and techniques for such CDR grafting will be clear to the skilled person and are well known in the art, see for example those mentioned in WO 08/020,079. For example, techniques known per se for grafting mouse or rat CDR's onto human frameworks and scaffolds can be used in an analogous manner to provide chimeric proteins comprising one or more of the CDR's of the Nanobodies of the invention and one or more human framework regions or sequences.

It should also be noted that, when the Nanobodies of the inventions contain one or more other CDR sequences than the preferred CDR sequences mentioned above, these CDR sequences can be obtained in any manner known per se, for example using one or more of the techniques described in WO 08/020,079.

Further uses of the amino acid sequences, Nanobodies, polypeptides, nucleic acids, genetic constructs and hosts and host cells of the invention will be clear to the skilled person based on the disclosure herein. For example, and without limitation, the amino acid sequences of the invention can be linked to a suitable carrier or solid support so as to provide a medium than can be used in a manner known per se to purify IL-6R from compositions and preparations comprising the same. Derivatives of the amino acid sequences of the invention that comprise a suitable detectable label can also be used as markers to determine (qualitatively or quantitatively) the presence of IL-6R in a composition or preparation or as a marker to selectively detect the presence of IL-6R on the surface of a cell or tissue (for example, in combination with suitable cell sorting techniques).

The entire contents of all of the references (including literature references, issued patents, published patent applications, and co-pending patent applications) cited throughout this application are hereby expressly incorporated by reference, in particular for the teaching that is referenced hereinabove. The invention will now be further described by means of the following non-limiting preferred aspects, examples and figures.

Aspects

1. Polypeptide that is directed against and/or can specifically bind IL-6R, which is a multiparatopic polypeptide.
2. Polypeptide according to aspect 1, which is a biparatopic polypeptide.
3. Polypeptide according to any of aspects 1 or 2, which comprises at least one amino acid sequence directed against a first antigenic determinant, epitope, part or domain of IL-6R and at least one amino acid sequence directed against a second antigenic determinant, epitope, part or domain of IL-6R different from the first antigenic determinant, epitope, part or domain, optionally linked via a suitable linker.
4. Biparatopic polypeptide according to aspect 3, which is capable of simultaneously binding to said first antigenic determinant, epitope, part or domain of IL-6R and to said second antigenic determinant, epitope, part or domain of IL-6R.
5. Polypeptide according to any of aspects 1 to 4, wherein said polypeptide is directed against the IL-6 binding site on IL-6R.
6. Polypeptide according to any of aspects 1 to 5, wherein said polypeptide competes with IL-6 for binding to IL-6R.
7. Polypeptide according to any of aspects 1 to 6, wherein said polypeptide inhibits and/or blocks binding of IL-6 to IL-6R.

8. Polypeptide according to any of aspects 1 to 7, wherein said polypeptide specifically binds one or more of the 18 contact residues as described in Boulanger et al. 2003 (Science 300: 2101-2104) present in the extracellular 03 domain of the IL-6R.
9. Polypeptide according to any of aspects 1 to 8, wherein said polypeptide specifically binds amino acid residues Phe229 and Phe279 present in the extracellular D3 domain of the IL-6R.
10. Polypeptide according to any of aspects 1 to 9, wherein said polypeptide is directed against the gp130 binding site on IL-6R and/or the IL-6/IL-6R complex.
11. Polypeptide according to any of aspects 1 to 10, wherein said polypeptide competes with gp130 for binding to the IL-6/IL-6R complex.
12. Polypeptide according to any of aspects 1 to 11, wherein said polypeptide inhibits and/or blocks binding of gp130 to the IL-6/IL-6R complex.
13. Polypeptide according to any of aspects 1 to 12, wherein said polypeptide is directed against the Tocilizumab (MRA) binding site on IL-6R.
14. Polypeptide according to any of aspects 1 to 13, wherein said polypeptide competes with Tocilizumab (MRA) for binding to IL-6R.
15. Polypeptide according to any of aspects 1 to 14, wherein said polypeptide inhibits and/or blocks binding of Tocilizumab (MRA) to IL-6R.
16. Polypeptide according to any of aspects 1 to 15, wherein said polypeptide is directed against the binding site for the reference IgG or the reference Fab on IL-6R.
17. Polypeptide according to any of aspects 1 to 16, wherein said polypeptide competes with the reference IgG or the reference Fab for binding to IL-6R.
18. Polypeptide according to any of aspects 1 to 17, wherein said polypeptide inhibits and/or blocks binding of the reference IgG or the reference Fab to IL-6R.
19. Polypeptide according to any of aspects 1 to 18, wherein said polypeptide is directed against the M182 binding site on IL-6R.
20. Polypeptide according to any of aspects 1 to 19, wherein said polypeptide competes with M182 for binding to IL-6R.
21. Polypeptide according to any of aspects 1 to 20, wherein said polypeptide inhibits and/or blocks binding of M182 to IL-6R.
22. Polypeptide according to any of aspects 1 to 21, wherein said polypeptide is directed against the BN-12 binding site on IL-6R.
23. Polypeptide according to any of aspects 1 to 22, wherein said polypeptide competes with BN-12 for binding to IL-6R.
24. Polypeptide according to any of aspects 1 to 23, wherein said polypeptide inhibits and/or blocks binding of BN-12 to IL-6R.
25. Biparatopic polypeptide according to any of aspects 1 to 4, which can simultaneously bind the IL-6 binding site on IL-6R and another antigenic determinant or epitope in the D1 domain on IL-6R.
26. Biparatopic polypeptide according to any of aspects 1 to 4, which can simultaneously bind the IL-6 binding site on IL-6R and another antigenic determinant or epitope in the D2 domain on IL-6R.
27. Biparatopic polypeptide according to any of aspects 1 to 4, which can simultaneously bind the IL-6 binding site on IL-6R and another antigenic determinant or epitope in the D3 domain on IL-6R.
28. Biparatopic polypeptide according to any of aspects 1 to 4, which can simultaneously bind the gp130 binding site on IL-6R and/or the IL-6/IL-6R complex and another antigenic determinant or epitope in the D1 domain on IL-6R.
29. Biparatopic polypeptide according to any of aspects 1 to 4, which can simultaneously bind the gp130 binding site on IL-6R and/or the IL-6/IL-6R complex and another antigenic determinant or epitope in the D2 domain on IL-6R.
30. Biparatopic polypeptide according to any of aspects 1 to 4, which can simultaneously bind the gp130 binding site on IL-6R and/or the IL-6/IL-6R complex and another antigenic determinant or epitope in the D3 domain on IL-6R.
31. Biparatopic polypeptide according to any of aspects 1 to 4, which can simultaneously bind the Tocilizumab (MRA) binding site on IL-6R and another antigenic determinant or epitope in the D1 domain on IL-6R.
32. Biparatopic polypeptide according to any of aspects 1 to 4, which can simultaneously bind the Tocilizumab (MRA) binding site on IL-6R and another antigenic determinant or epitope in the D2 domain on IL-6R.
33. Biparatopic polypeptide according to any of aspects 1 to 4, which can simultaneously bind the Tocilizumab (MRA) binding site on IL-6R and another antigenic determinant or epitope in the 03 domain on IL-6R.
34. Biparatopic polypeptide according to any of aspects 1 to 4, which can simultaneously bind the binding site for the reference IgG and the reference Fab on IL-6R and another antigenic determinant or epitope in the D1 domain on IL-6R.
35. Biparatopic polypeptide according to any of aspects 1 to 4, which can simultaneously bind the binding site for the reference IgG and the reference Fab on IL-6R and another antigenic determinant or epitope in the D2 domain on IL-6R.
36. Biparatopic polypeptide according to any of aspects 1 to 4, which can simultaneously bind the binding site for the reference IgG and the reference Fab on IL-6R and another antigenic determinant or epitope in the D3 domain on IL-6R.
37. Biparatopic polypeptide according to any of aspects 1 to 4, which can simultaneously bind the M182 binding site on IL-6R and another antigenic determinant or epitope in the D1 domain on IL-6R.
38. Biparatopic polypeptide according to any of aspects 1 to 4, which can simultaneously bind the M182 binding site on IL-6R and another antigenic determinant or epitope in the D2 domain on IL-6R.
39. Biparatopic polypeptide according to any of aspects 1 to 4, which can simultaneously bind the M182 binding site on IL-6R and another antigenic determinant or epitope in the D3 domain on IL-6R.
40. Biparatopic polypeptide according to any of aspects 1 to 4, which can simultaneously bind the BN-12 binding site on IL-6R and another antigenic determinant or epitope in the D1 domain on IL-6R.
41. Biparatopic polypeptide according to any of aspects 1 to 4, which can simultaneously bind the BN-12 binding site on IL-6R and another antigenic determinant or epitope in the D2 domain on IL-6R.
42. Biparatopic polypeptide according to any of aspects 1 to 4, which can simultaneously bind the BN-12 binding site on IL-6R and another antigenic determinant or epitope in the D3 domain on IL-6R.

43. Biparatopic polypeptide according to any of aspects 1 to 4, which has both paratopes directed against the IL-6 binding site on IL-6R.
44. Biparatopic polypeptide according to any of aspects 1 to 4, which can simultaneously bind the IL-6 binding site on IL-6R and one or more of the 18 contact residues as described in Boulanger et al. 2003 (Science 300: 2101-2104) present in the extracellular D3 domain of the IL-6R.
45. Biparatopic polypeptide according to any of aspects 1 to 4, which can simultaneously bind the IL-6 binding site on IL-6R and amino acid residues Phe229 and Phe279 present in the extracellular D3 domain of the IL-6R.
46. Polypeptide according to any of aspects 1 to 4, wherein said polypeptide is directed against the IL-6 binding site on IL-6R and against the binding site for the reference IgG and the reference Fab on IL-6R.
47. Polypeptide according to any of aspects 1 to 4, wherein said polypeptide competes with IL-6 for binding to IL-6R and competes with the reference IgG and the reference Fab for binding to IL-6R.
48. Biparatopic polypeptide according to any of aspects 1 to 4, which can simultaneously bind the IL-6 binding site on IL-6R and the binding site for the reference IgG and the reference Fab on IL-6R.
49. Polypeptide according to any of aspects 1 to 4, wherein said polypeptide is directed against the IL-6 binding site on IL-6R and against the Tocilizumab (MRA) binding site on IL-6R.
50. Polypeptide according to any of aspects 1 to 4, wherein said polypeptide competes with IL-6 for binding to IL-6R and competes with Tocilizumab (MRA) for binding to IL-6R.
51. Biparatopic polypeptide according to any of aspects 1 to 4, which can simultaneously bind the IL-6 binding site on IL-6R and the Tocilizumab (MRA) binding site on IL-6R.
52. Biparatopic polypeptide according to any of aspects 1 to 4, which has both paratopes directed against the gp130 binding site on IL-6R and/or the IL-6/IL-6R complex.
53. Polypeptide according to any of aspects 1 to 4, wherein said polypeptide is directed against the M182 binding site on IL-6R and against the gp130 binding site on IL-6R and/or the IL-6/IL-6R complex.
54. Polypeptide according to any of aspects 1 to 4, wherein said polypeptide competes with M182 for binding to IL-6R and competes with gp130 for binding to the IL-6R/IL-6R complex.
55. Biparatopic polypeptide according to any of aspects 1 to 4, which can simultaneously bind the M182 binding site on IL-6R and the gp130 binding site on IL-6R and/or the IL-6/IL-6R complex.
56. Biparatopic polypeptide according to any of aspects 1 to 4, which has both paratopes directed against the Tocilizumab (MRA) binding site on IL-6R.
57. Biparatopic polypeptide according to any of aspects 1 to 4, which has both paratopes directed against the binding site for the reference IgG and the reference Fab on IL-6R.
58. Biparatopic polypeptide according to any of aspects 1 to 4, which has both paratopes directed against the M182 binding site on IL-6R.
59. Biparatopic polypeptide according to any of aspects 1 to 4, which has both paratopes directed against the BN-12 binding site on IL-6R.
60. Polypeptide according to any of aspects 1 to 4, wherein said polypeptide is directed against the IL-6 binding site on IL-6R and against the gp130 binding site on IL-6R and/or the IL-6/IL-6R complex.
61. Polypeptide according to any of aspects 1 to 4, wherein said polypeptide competes with IL-6 for binding to IL-6R and competes with gp130 for binding to the IL-6R/IL-6R complex.
62. Biparatopic polypeptide according to any of aspects 1 to 4, which can simultaneously bind the IL-6 binding site on IL-6R and the gp130 binding site on IL-6R and/or the IL-6/IL-6R complex.
63. Polypeptide according to any of aspects 1 to 4, wherein said polypeptide is directed against the binding site for the reference IgG and the reference Fab on IL-6R and against the gp130 binding site on IL-6R and/or the IL-6/IL-6R complex.
64. Polypeptide according to any of aspects 1 to 4, wherein said polypeptide competes with the reference IgG and the reference Fab for binding to IL-6R and competes with gp130 for binding to the IL-6R/IL-6R complex.
65. Biparatopic polypeptide according to any of aspects 1 to 4, which can simultaneously bind the binding site for the reference IgG and the reference Fab on IL-6R and the gp130 binding site on IL-6R and/or the IL-6/IL-6R complex.
66. Polypeptide according to any of aspects 1 to 4, wherein said polypeptide is directed against the IL-6 binding site on IL-6R and against the M182 binding site on IL-6R.
67. Polypeptide according to any of aspects 1 to 4, wherein said polypeptide competes with IL-6 for binding to IL-6R and competes with M182 for binding to IL-6R.
68. Biparatopic polypeptide according to any of aspects 1 to 4, which can simultaneously bind the IL-6 binding site on IL-6R and the M182 binding site on IL-6R.
69. Polypeptide according to any of aspects 1 to 4, wherein said polypeptide is directed against the IL-6 binding site on IL-6R and against the BN-12 binding site on IL-6R.
70. Polypeptide according to any of aspects 1 to 4, wherein said polypeptide competes with IL-6 for binding to IL-6R and competes with BN-12 for binding to IL-6R.
71. Biparatopic polypeptide according to any of aspects 1 to 4, which can simultaneously bind the IL-6 binding site on IL-6R and the BN-12 binding site on IL-6R.
72. Polypeptide according to any of aspects 1 to 4, wherein said polypeptide is directed against the Tocilizumab (MRA) binding site on IL-6R and against the gp130 binding site on IL-6R and/or the IL-6/IL-6R complex.
73. Polypeptide according to any of aspects 1 to 4, wherein said polypeptide competes with Tocilizumab (MRA) for binding to IL-6R and competes with gp130 for binding to the IL-6/IL-6R complex.
74. Biparatopic polypeptide according to any of aspects 1 to 4, which can simultaneously bind the Tocilizumab (MRA) binding site on IL-6R and the gp130 binding site on IL-6R and/or the IL-6/IL-6R complex.
75. Polypeptide according to any of aspects 1 to 4, wherein said polypeptide is directed against the Tocilizumab (MRA) binding site on IL-6R and against the M182 binding site on IL-6R.
76. Polypeptide according to any of aspects 1 to 4, wherein said polypeptide competes with Tocilizumab (MRA) for binding to IL-6R and competes with M182 for binding to IL-6R.
77. Biparatopic polypeptide according to any of aspects 1 to 4, which can simultaneously bind the Tocilizumab (MRA) binding site on IL-6R and the M182 binding site on IL-6R.

78. Polypeptide according to any of aspects 1 to 4, wherein said polypeptide is directed against the Tocilizumab (MRA) binding site on IL-6R and against the BN-12 binding site on IL-6R.

79. Polypeptide according to any of aspects 1 to 4, wherein said polypeptide competes with Tocilizumab (MRA) for binding to IL-6R and competes with BN-12 for binding to IL-6R.

80. Biparatopic polypeptide according to any of aspects 1 to 4, which can simultaneously bind the Tocilizumab (MRA) binding site on IL-6R and the BN-12 binding site on IL-6R.

81. Polypeptide according to any of aspects 1 to 4, wherein said polypeptide is directed against the binding site for the reference IgG and the reference Fab on IL-6R and against the gp130 binding site on IL-6R and/or the IL-6/IL-6R complex.

82. Polypeptide according to any of aspects 1 to 4, wherein said polypeptide competes with the reference IgG and the reference Fab for binding to IL-6R and competes with gp130 for binding to the IL-6/IL-6R complex.

83. Biparatopic polypeptide according to any of aspects 1 to 4, which can simultaneously bind the binding site for the reference IgG and the reference Fab on IL-6R and the gp130 binding site on IL-6R and/or the IL-6/IL-6R complex.

84. Polypeptide according to any of aspects 1 to 4, wherein said polypeptide is directed against the binding site for the reference IgG and the reference Fab on IL-6R and against the M182 binding site on IL-6R.

85. Polypeptide according to any of aspects 1 to 4, wherein said polypeptide competes with the reference IgG and the reference Fab for binding to IL-6R and competes with M182 for binding to IL-6R.

86. Biparatopic polypeptide according to any of aspects 1 to 4, which can simultaneously bind the binding site for the reference IgG and the reference Fab on IL-6R and the M182 binding site on IL-6R.

87. Polypeptide according to any of aspects 1 to 4, wherein said polypeptide is directed against the binding site for the reference IgG and the reference Fab on IL-6R and against the BN-12 binding site on IL-6R.

88. Polypeptide according to any of aspects 1 to 4, wherein said polypeptide competes with the reference IgG and the reference Fab for binding to IL-6R and competes with BN-12 for binding to IL-6R.

89. Biparatopic polypeptide according to any of aspects 1 to 4, which can simultaneously bind the binding site for the reference IgG and the reference Fab on IL-6R and the BN-12 binding site on IL-6R.

90. Polypeptide according to any of aspects 1 to 4, wherein said polypeptide is directed against the BN-12 binding site on IL-6R and against the gp130 binding site on IL-6R and/or the IL-6/IL-6R complex.

91. Polypeptide according to any of aspects 1 to 4, wherein said polypeptide competes with BN-12 for binding to IL-6R and competes with gp130 for binding to IL-6R and/or the IL-6/IL-6R complex.

92. Biparatopic polypeptide according to any of aspects 1 to 4, which can simultaneously bind the BN-12 binding site on IL-6R and the gp130 binding site on IL-6R and/or the IL-6/IL-6R complex.

93. Polypeptide according to any of aspects 1 to 4, wherein said polypeptide is directed against the BN-12 binding site on IL-6R and against the M182 binding site on IL-6R.

94. Polypeptide according to any of aspects 1 to 4, wherein said polypeptide competes with BN-12 for binding to IL-6R and competes with M182 for binding to IL-6R.

95. Biparatopic polypeptide according to any of aspects 1 to 4, which can simultaneously bind the BN-12 binding site on IL-6R and the M182 binding site on IL-6R.

96. Polypeptide according to any of aspects 1 to 95, which combines two or more different modes of action each mediated by one of its binding units, wherein each binding unit binds at a different binding site of IL-6R.

97. Polypeptide according to any of aspects 1 to 96, wherein said polypeptide inhibit or affects (e.g. fully or partially disrupts) the formation of the IL-6/IL-6R complex in such a way that the signalling, pathway(s) and/or mechanism(s) induced/mediated by the binding of IL-6 to IL-6R is modulated (e.g. reduced) compared to the signalling, pathway(s) and/or mechanism(s) induced/mediated by the binding of IL-6 to IL-6R without the presence of said polypeptide.

98. Polypeptide according to any of aspects 1 to 97, wherein said polypeptide inhibits or affects (e.g. fully or partially disrupts) the formation of the IL-6/IL-6R complex is in such a way that the signalling, pathway(s) and/or mechanism(s) induced/mediated by the binding of the complex to gp130 is modulated (e.g. reduced) compared to the signalling, pathway(s) and/or mechanism(s) induced/mediated by the binding of the complex to gp130 without the presence of said polypeptide.

99. Polypeptide according to any of aspects 1 to 98, wherein said polypeptide modulates (e.g. inhibit) the binding of the IL-6/IL-6R complex to gp130, so that the signalling, pathway(s) and/or mechanism(s) induced/mediated by the binding of the IL-6/IL-6R complex to gp130 is modulated (e.g. reduced) compared to the signalling, pathway(s) and/or mechanism(s) induced/mediated by the binding of the IL-6/IL-6R complex to gp130 without the presence of said polypeptide.

100. Polypeptide according to any of aspects 1 to 99, wherein said polypeptide inhibits or affects (e.g. fully or partially disrupts) the formation of the IL-6/IL-6R complex in such a way that the signalling, pathway(s) and/or mechanism(s) induced/mediated by the binding of IL-6 to IL-6R is modulated (e.g. reduced) compared to the signalling, pathway(s) and/or mechanism(s) induced/mediated by the binding of IL-6 to IL-6R without the presence of said polypeptide; and in such a way that the signalling, pathway(s) and/or mechanism(s) induced/mediated by the binding of the complex to gp130 is modulated (e.g. reduced) compared to the signalling, pathway(s) and/or mechanism(s) induced/mediated by the binding of the complex to gp130 without the presence of said polypeptide.

101. Polypeptide according to any of aspects 1 to 99, wherein said polypeptide inhibits or affects (e.g. fully or partially disrupts) the formation of the IL-6/IL-6R complex in such a way that the signalling, pathway(s) and/or mechanism(s) induced/mediated by the binding of IL-6 to IL-6R is modulated (e.g. reduced) compared to the signalling, pathway(s) and/or mechanism(s) induced/mediated by the binding of IL-6 to IL-6R without the presence of said polypeptide; and wherein said compound or construct modulates (e.g. inhibit) the binding of the IL-6/IL-6R complex to gp130 in such a way that the signalling, pathway(s) and/or mechanism(s) induced/mediated by the binding of the IL-6/IL-6R complex to gp130 is modulated (e.g. reduced) compared to the signalling, pathway(s)

and/or mechanism(s) induced/mediated by the binding of the IL-6/IL-6R complex to gp130 without the presence of said polypeptide.

102. Polypeptide according to any of aspects 1 to 99, wherein said polypeptide inhibits or affects (e.g. fully or partially disrupts) the formation of the IL-6/IL-6R complex and wherein said polypeptide modulates (e.g. inhibit) the binding of the IL-6/IL-6R complex to gp130 in such a way that the signalling, pathway(s) and/or mechanism(s) induced/mediated by the binding of the complex to gp130 is modulated (e.g. reduced) compared to the signalling, pathway(s) and/or mechanism(s) induced/mediated by the binding of the complex to gp130 without the presence of said polypeptide.

103. Polypeptide according to any of aspects 1 to 24, wherein said polypeptide modulates IL-6R or IL-6R mediated signalling via the same mechanism of action as Tocilizumab (MRA).

104. Polypeptide according to any of aspects 1 to 24, wherein said polypeptide modulates IL-6R or IL-6R mediated signalling via the same mechanism of action as the reference IgG and the reference Fab.

105. Polypeptide according to any of aspects 1 to 24, wherein said polypeptide modulates IL-6R or IL-6R mediated signalling via the same mechanism of action as M182.

106. Polypeptide according to any of aspects 1 to 4, wherein said polypeptide modulates IL-6R or IL-6R mediated signalling via the same mechanism of action as Tocilizumab (MRA) and via the same mechanism of action as M182.

107. Polypeptide according to any of aspects 1 to 4, wherein said polypeptide modulates IL-6R or IL-6R mediated signalling via the same mechanism of action as the reference IgG and the reference Fab and via the same mechanism of action as M182.

108. Polypeptide according to any of aspects 1 to 107, which comprises or essentially consists of amino acid sequences that are chosen from the group consisting of domain antibodies, amino acid sequences that are suitable for use as a domain antibody, single domain antibodies, amino acid sequences that are suitable for use as a single domain antibody, "dAb"'s, amino acid sequences that are suitable for use as a dAb, or Nanobodies.

109. Polypeptide according to any of aspects 1 to 4, wherein the first amino acid sequence or Nanobody is directed against the IL-6 binding site on IL-6R and/or is an amino acid sequence or Nanobody that is capable of competing with IL-6 for binding to IL-6R.

110. Polypeptide according to any of aspects 1 to 4, wherein the first amino acid sequence or Nanobody is directed against the gp130 binding site on IL-6R and/or the IL-6/IL-6R complex and/or is an amino acid sequence or Nanobody that is capable of competing with gp130 for binding to the IL-6/IL-6R complex.

111. Polypeptide according to any of aspects 1 to 4, wherein the first amino acid sequence or Nanobody is directed against the Tocilizumab (MRA) binding site on IL-6R and/or is an amino acid sequence or Nanobody that is capable of competing with Tocilizumab (MRA) for binding to IL-6R.

112. Polypeptide according to any of aspects 1 to 4, wherein the first amino acid sequence or Nanobody is directed against the binding site for the reference IgG and the reference Fab on IL-6R and/or is an amino acid sequence or Nanobody that is capable of competing with the reference IgG and the reference Fab for binding to IL-6R.

113. Polypeptide according to any of aspects 1 to 4, wherein the first amino acid sequence or Nanobody is directed against the M182 binding site on IL-6R and/or is an amino acid sequence or Nanobody that is capable of competing with M182 for binding to IL-6R.

114. Polypeptide according to any of aspects 1 to 4, wherein the first amino acid sequence or Nanobody is directed against the BN-12 binding site on IL-6R and/or is an amino acid sequence or Nanobody that is capable of competing with BN-12 for binding to IL-6R.

115. Polypeptide according to any of aspects 1 to 4, wherein the first amino acid sequence or Nanobody is directed against the IL-6 binding site on IL-6R and/or is an amino acid sequence or Nanobody that is capable of competing with IL-6 for binding to IL-6R and the second amino acid sequence or Nanobody is directed against the gp130 binding site on IL-6R and/or the IL-6/IL-6R complex and/or is an amino acid sequence or Nanobody that is capable of competing with gp130 for binding to the IL-6/IL-6R complex (or visa versa).

116. Polypeptide according to any of aspects 1 to 4, wherein the first amino acid sequence or Nanobody is directed against the IL-6 binding site on IL-6R and/or is an amino acid sequence or Nanobody that is capable of competing with IL-6 for binding to IL-6R and the second amino acid sequence or Nanobody is directed against the M182 binding site on IL-6R and/or is an amino acid sequence or Nanobody that is capable of competing with M182 for binding to the IL-6R (or visa versa).

117. Polypeptide according to any of aspects 1 to 4, wherein the first amino acid sequence or Nanobody is directed against the IL-6 binding site on IL-6R and/or is an amino acid sequence or Nanobody that is capable of competing with IL-6 for binding to IL-6R and the second amino acid sequence or Nanobody is directed against the BN-12 binding site on IL-6R and/or is an amino acid sequence or Nanobody that is capable of competing with BN-12 for binding to the IL-6R (or visa versa).

118. Polypeptide according to any of aspects 1 to 4, wherein the first amino acid sequence or Nanobody is directed against the Tocilizumab (MRA) binding site on IL-6R and/or is an amino acid sequence or Nanobody that is capable of competing with Tocilizumab (MRA) for binding to IL-6R and the second amino acid sequence or Nanobody is directed against the gp130 binding site on IL-6R and/or the IL-6/IL-6R complex and/or is an amino acid sequence or Nanobody that is capable of competing with gp130 for binding to the IL-6/IL-6R complex (or visa versa).

119. Polypeptide according to any of aspects 1 to 4, wherein the first amino acid sequence or Nanobody is directed against the Tocilizumab (MRA) binding site on IL-6R and/or is an amino acid sequence or Nanobody that is capable of competing with Tocilizumab (MRA) for binding to IL-6R and the second amino acid sequence or Nanobody is directed against the M182 binding site on IL-6R and/or is an amino acid sequence or Nanobody that is capable of competing with M182 for binding to the IL-6R (or visa versa).

120. Polypeptide according to any of aspects 1 to 4, wherein the first amino acid sequence or Nanobody is directed against the Tocilizumab (MM) binding site on IL-6R and/or is an amino acid sequence or Nanobody that is capable of competing with Tocilizumab (MRA) for binding to IL-6R and the second amino acid sequence or Nanobody is directed against the BN-12 binding site on IL-6R and/or is an amino acid sequence or Nanobody that is capable of competing with BN-12 for binding to the IL-6R (or visa versa).

121. Polypeptide according to any of aspects 1 to 4, wherein the first amino acid sequence or Nanobody is directed against the binding site for the reference IgG and the reference Fab on IL-BR and/or is an amino acid sequence or Nanobody that is capable of competing with the reference IgG and the reference Fab for binding to IL-6R and the second amino acid sequence or Nanobody is directed against the gp130 binding site on IL-6R and/or the IL-6/IL-6R complex and/or is an amino acid sequence or Nanobody that is capable of competing with gp130 for binding to the IL-6/IL-6R complex (or visa versa).

122. Polypeptide according to any of aspects 1 to 4, wherein the first amino acid sequence or Nanobody is directed against the binding site for the reference IgG and the reference Fab on IL-6R and/or is an amino acid sequence or Nanobody that is capable of competing with the reference IgG and the reference Fab for binding to IL-6R and the second amino acid sequence or Nanobody is directed against the M182 binding site on IL-6R and/or is an amino acid sequence or Nanobody that is capable of competing with M182 for binding to the IL-6R (or visa versa).

123. Polypeptide according to any of aspects 1 to 4, wherein the first amino acid sequence or Nanobody is directed against the binding site for the reference IgG and the reference Fab on IL-6R and/or is an amino acid sequence or Nanobody that is capable of competing with the reference IgG and the reference Fab for binding to IL-6R and the second amino acid sequence or Nanobody is directed against the BN-12 binding site on IL-6R and/or is an amino acid sequence or Nanobody that is capable of competing with BN-12 for binding to the IL-6R (or visa versa).

124. Polypeptide according to any of aspects 1 to 4, wherein the first amino acid sequence or Nanobody is directed against the BN-12 binding site on IL-6R and/or is an amino acid sequence or Nanobody that is capable of competing with BN-12 for binding to IL-6R and the second amino acid sequence or Nanobody is directed against the gp130 binding site on IL-6R and/or the IL-6/IL-6R complex and/or is an amino acid sequence or Nanobody that is capable of competing with gp130 for binding to the IL-6/IL-6R complex (or visa versa).

125. Polypeptide according to any of aspects 1 to 4, wherein the first amino acid sequence or Nanobody is directed against the BN-12 binding site on IL-6R and/or is an amino acid sequence or Nanobody that is capable of competing with BN-12 for binding to IL-6R and the second amino acid sequence or Nanobody is directed against the M182 binding site on IL-6R and/or is an amino acid sequence or Nanobody that is capable of competing with M182 for binding to IL-6R (or visa versa).

126. Polypeptide according to any of aspects 1 to 4, wherein the first amino acid sequence or Nanobody is an amino acid sequence according to any of aspects 133 to 186 or Nanobody according to any of aspects 187 to 197 and/or is an amino acid sequence or Nanobody that is capable of competing with an amino acid sequence according to any of aspects 133 to 186 or Nanobody according to any of aspects 187 to 197.

127. Polypeptide according to any of aspects 1 to 4, wherein the second amino acid sequence or Nanobody is an amino acid sequence according to any of aspects 133 to 186 or Nanobody according to any of aspects 187 to 197 and/or is an amino acid sequence or Nanobody that is capable of competing with an amino acid sequence according to any of aspects 133 to 186 or Nanobody according to any of aspects 187 to 197.

128. Polypeptide according to any of aspects 1 to 4, wherein the first amino acid sequence or Nanobody is an amino acid sequence according to any of aspects 133 to 186 or Nanobody according to any of aspects 187 to 197 and/or is an amino acid sequence or Nanobody that is capable of competing with an amino acid sequence according to any of aspects 133 to 186 or Nanobody according to any of aspects 187 to 197 and the second amino acid sequence or Nanobody is an amino acid sequence according to any of aspects 133 to 186 or Nanobody according to any of aspects 187 to 197 and/or is an amino acid sequence or Nanobody that is capable of competing with an amino acid sequence according to any of aspects s 133 to 186 or Nanobody according to any of aspects 187 to 197.

129. Polypeptide according to any of aspects 1 to 4, wherein the first amino acid sequence or Nanobody is chosen from the groups consisting of SEQ ID NO's: 132-216 or from the group consisting of amino acid sequences that have more than 80%, preferably more than 90%, more preferably more than 95%, such as 99% or more sequence identity (as defined herein) with at least one of the amino acid sequences of SEQ ID NO's: 132-216 and/or is an amino acid sequence or Nanobody that is capable of competing with an amino acid sequence or Nanobody chosen from the groups consisting of SEQ ID NO's: 132-216 for binding to IL-6R.

130. Polypeptide according to any of aspects 1 to 4, wherein the second amino acid sequence or Nanobody is chosen from the groups consisting of SEQ ID NO's: 132-216 or from the group consisting of amino acid sequences that have more than 80%, preferably more than 90%, more preferably more than 95%, such as 99% or more sequence identity (as defined herein) with at least one of the amino acid sequences of SEQ ID NO's: 132-216 and/or is an amino acid sequence or Nanobody that is capable of competing with an amino acid sequence or Nanobody chosen from the groups consisting of SEQ ID NO's: 132-216 for binding to IL-6R.

131. Polypeptide according to any of aspects 1 to 4, wherein the first amino add sequence or Nanobody is chosen from the groups consisting of SEQ ID NO's: 132-216 or from the group consisting of amino acid sequences that have more than 80%, preferably more than 90%, more preferably more than 95%, such as 99% or more sequence identity (as defined herein) with at least one of the amino acid sequences of SEQ ID NO's: 132-216 and/or is an amino acid sequence or Nanobody that is capable of competing with an amino acid sequence or Nanobody chosen from the groups consisting of SEQ ID NO's: 132-216 for binding to IL-6R; and the second amino acid sequence or Nanobody is chosen from the groups consisting of SEQ ID NO's: 132-216 or from the group consisting of amino acid sequences that have more than 80%, preferably more than 90%, more preferably more than 95%, such as 99% or more sequence identity (as defined herein) with at least one of the amino acid sequences of SEQ ID NO's: 132-216 and/or is an amino acid sequence or Nanobody that is capable of competing with an amino acid sequence or Nanobody chosen from the groups consisting of SEQ ID NO's: 132-216 for binding to IL-6R.

132. Polypeptide according to any of aspects 1 to 4, that comprises, essentially consists of, or that is chosen from the group consisting of SEQ ID NO's: 812-947 or from the group consisting of amino acid sequences that have more than 80%, preferably more than 90%, more preferably more than 95%, such as 99% or more sequence identity (as defined herein) with at least one of the amino acid sequences of SEQ ID NO's: 812-947.

133. An amino acid sequence that is directed against and/or that can specifically bind IL-6R, and that comprises one or more stretches of amino acid residues chosen from the group consisting of:
a) the amino acid sequences of SEQ ID NO's: 302-386;
b) amino acid sequences that have at least 80% amino acid identity with at least one of the amino acid sequences of SEQ ID NO's: 302-386;
c) amino acid sequences that have 3, 2, or 1 amino acid difference with at least one of the amino acid sequences of SEQ ID NO's: 302-386;
d) the amino acid sequences of SEQ ID NO's: 472-556;
e) amino acid sequences that have at least 80% amino acid identity with at least one of the amino acid sequences of SEQ ID NO's: 472-556;
f) amino acid sequences that have 3, 2, or 1 amino acid difference with at least one of the amino acid sequences of SEQ ID NO's: 472-556;
g) the amino acid sequences of SEQ ID NO's: 642-726;
h) amino acid sequences that have at least 80% amino acid identity with at least one of the amino acid sequences of SEQ ID NO's: 642-726;
i) amino acid sequences that have 3, 2, or 1 amino acid difference with at least one of the amino acid sequences of SEQ ID NO's: 642-726; or any suitable combination thereof.

134. An amino acid sequence according to aspect 133, in which at least one of said stretches of amino acid residues forms part of the antigen binding site for binding against IL-6R.

135. An amino acid sequence according to any of aspects 133 or 134 that is directed against and/or that can specifically bind IL-6R and that comprises two or more stretches of amino acid residues chosen from the group consisting of:
a) the amino acid sequences of SEQ ID NO's: 302-386;
b) amino acid sequences that have at least 80% amino acid identity with at least one of the amino acid sequences of SEQ ID NO's: 302-386;
c) amino acid sequences that have 3, 2, or 1 amino acid difference with at least one of the amino acid sequences of SEQ ID NO's: 302-386;
d) the amino acid sequences of SEQ ID NO's: 472-556;
e) amino acid sequences that have at least 80% amino acid identity with at least one of the amino acid sequences of SEQ ID NO's: 472-556;
f) amino acid sequences that have 3, 2, or 1 amino acid difference with at least one of the amino acid sequences of SEQ ID NO's: 472-556;
g) the amino acid sequences of SEQ ID NO's: 642-726;
h) amino acid sequences that have at least 80% amino acid identity with at least one of the amino acid sequences of SEQ ID NO's: 642-726;
i) amino acid sequences that have 3, 2, or 1 amino acid difference with at least one of the amino acid sequences of SEQ ID NO's: 642-726;
such that (i) when the first stretch of amino acid residues corresponds to one of the amino acid sequences according to a), b) or c), the second stretch of amino acid residues corresponds to one of the amino acid sequences according to d), e), f), g), h) or 1); (ii) when the first stretch of amino acid residues corresponds to one of the amino acid sequences according to d), e) or f), the second stretch of amino acid residues corresponds to one of the amino acid sequences according to a), b), c), g), h) or i); or (iii) when the first stretch of amino acid residues corresponds to one of the amino acid sequences according to g), h) or i), the second stretch of amino acid residues corresponds to one of the amino acid sequences according to a), b), c), d), e) or f).

136. An amino acid sequence according to aspect 135, in which the at least two stretches of amino acid residues forms part of the antigen binding site for binding against IL-6R.

137. An amino acid sequence according to any of aspects 133-136 that is directed against and/or that can specifically bind IL-6R and that comprises three or more stretches of amino acid residues, in which the first stretch of amino acid residues is chosen from the group consisting of:
a) the amino acid sequences of SEQ ID NO's: 302-386;
b) amino acid sequences that have at least 80% amino acid identity with at least one of the amino acid sequences of SEQ ID NO's: 302-386;
c) amino acid sequences that have 3, 2, or 1 amino acid difference with at least one of the amino acid sequences of SEQ ID NO's: 302-386; the second stretch of amino acid residues is chosen from the group consisting of:
d) the amino acid sequences of SEQ ID NO's: 472-556;
e) amino acid sequences that have at least 80% amino acid identity with at least one of the amino acid sequences of SEQ ID NO's: 472-556;
f) amino acid sequences that have 3, 2, or 1 amino acid difference with at least one of the amino acid sequences of SEQ ID NO's: 472-556; and the third stretch of amino acid residues is chosen from the group consisting of:
g) the amino acid sequences of SEQ ID NO's: 642-726;
h) amino acid sequences that have at least 80% amino acid identity with at least one of the amino acid sequences of SEQ ID NO's: 642-726;
i) amino acid sequences that have 3, 2, or 1 amino acid difference with at least one of the amino acid sequences of SEQ ID NO's: 642-726.

138. An amino acid sequence according to aspect 137, in which the at least three stretches of amino acid residues forms part of the antigen binding site for binding against IL-6R.

139. An amino acid sequence that is directed against and/or that can specifically bind IL-6R in which the CDR sequences of said amino acid sequence have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 132-216. Such an amino acid sequence may in particular be an amino acid sequence according to any of the aspects 133-138.

140. An amino acid sequence that is directed against IL-6R and that cross-blocks the binding of at least one of the amino acid sequences of SEQ ID NO's: 132-216 to IL-6R. Such an amino acid sequence may in particular be an amino acid sequence according to any of the aspects 133-139. Also, preferably, such an amino acid sequence is able to specifically bind to IL-6R.

141. An amino acid sequence that is directed against IL-6R and that is cross-blocked from binding to IL-6R by at least one of the amino acid sequences of SEQ ID NO's:

132-216. Such an amino acid sequence may in particular be an amino acid sequence according to any of the aspects 133-140. Also, preferably, such an amino acid sequence is able to specifically bind to IL-6R.

142. An amino acid sequence according to any of aspects 140 or 141, wherein the ability of said amino acid sequence to cross-block or to be cross-blocked is detected in a Biacore assay.

143. An amino acid sequence according to any of aspects 140 to 142 wherein the ability of said amino acid sequence to cross-block or to be cross-blocked is detected in an ELISA assay.

144. An amino acid sequence according to any of aspects 133 to 143, that is in essentially isolated form.

145. An amino acid sequence according to any of aspects 133 to 144 for administration to a subject, wherein said amino acid sequence does not naturally occur in said subject.

146. An amino acid sequence according to any of aspects 133 to 145 that can specifically bind to IL-6R with a dissociation constant ($K_D$) of $10^{-5}$ to $10^{-12}$ moles/litre or less, and preferably $10^{-7}$ to $10^{-12}$ moles/litre or less and more preferably $10^{-8}$ to $10^{-12}$ moles/litre.

147. An amino acid sequence according to any of aspects 133 to 146 that can specifically bind to IL-6R with a rate of association ($k_{on}$-rate) of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$.

148. An amino acid sequence according to any of aspects 133 to 147 that can specifically bind to IL-6R with a rate of dissociation ($k_{off}$ rate) between 1 $s^{-1}$ and $10^{-6}$ $s^{-1}$ preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

149. An amino acid sequence according to any of aspects 133 to 148 that can specifically bind to IL 6R with an affinity less than 500 nM, preferably less than 200 nM, more preferably less than 10 nM, such as less than 500 µM.

150. An amino acid sequence according to any of aspects 133 to 149, that is a naturally occurring amino acid sequence (from any suitable species) or a synthetic or semi-synthetic amino acid sequence.

151. An amino acid sequence according to any of aspects 133 to 150 that comprises an immunoglobulin fold or that under suitable conditions is capable of forming an immunoglobulin fold.

152. An amino acid sequence according to any of aspects 133 to 151, that is an immunoglobulin sequence.

153. An amino acid sequence according to any of aspects 133 to 152, that is a naturally occurring immunoglobulin sequence (from any suitable species) or a synthetic or semi-synthetic immunoglobulin sequence.

154. An amino acid sequence according to any of aspects 133 to 153 that is a humanized immunoglobulin sequence, a camelized immunoglobulin sequence or an immunoglobulin sequence that has been obtained by techniques such as affinity maturation.

155. An amino acid sequence according to any of aspects 133 to 154 that essentially consists of a light chain variable domain sequence (e.g. a $V_L$-sequence); or of a heavy chain variable domain sequence (e.g. a $V_H$-sequence).

156. An amino acid sequence according to any of aspects 133 to 155, that essentially consists of a heavy chain variable domain sequence that is derived from a conventional four-chain antibody or that essentially consist of a heavy chain variable domain sequence that is derived from heavy chain antibody.

157. An amino acid sequence according to any of aspects 133 to 156, that essentially consists of a domain antibody (or an amino acid sequence that is suitable for use as a domain antibody), of a single domain antibody (or an amino acid sequence that is suitable for use as a single domain antibody), of a "dAb" (or an amino acid sequence that is suitable for use as a dAb) or of a Nanobody (including but not limited to a $V_{HH}$ sequence).

158. An amino acid sequence according to any of aspects 133 to 157 that essentially consists of a Nanobody.

159. An amino acid sequence according to any of aspects 133 to 158 that essentially consists of a Nanobody that
i) has at least 80% amino acid identity with at least one of the amino acid sequences of SEQ ID NO's: 1 to 22, in which for the purposes of determining the degree of amino acid identity, the amino acid residues that form the CDR sequences are disregarded; and in which:
ii) preferably one or more of the amino acid residues at positions 11, 37, 44, 45, 47, 83, 84, 103, 104 and 108 according to the Kabat numbering are chosen from the Hallmark residues mentioned in Table B-2.

160. An amino acid sequence according to any of aspects 133 to 159, that essentially consists of a Nanobody that
i) has at least 80% amino acid identity with at least one of the amino acid sequences of SEQ ID NO's: 132-216, in which for the purposes of determining the degree of amino acid identity, the amino acid residues that form the CDR sequences are disregarded; and in which:
ii) preferably one or more of the amino acid residues at positions 11, 37, 44, 45, 47, 83, 84, 103, 104 and 108 according to the Kabat numbering are chosen from the Hallmark residues mentioned in Table B-2.

161. An amino acid sequence according to any of aspects 133 to 160 that essentially consists of a humanized Nanobody.

162. An amino acid sequence that essentially consists of 4 framework regions (ER1 to FR4, respectively) and 3 complementarity determining regions (CDR1 to CDR3, respectively), in which:
CDR1 is chosen from the group consisting of:
  a) the amino acid sequences of SEQ ID NO's: 302-386;
  b) amino acid sequences that have at least 80% amino acid identity with at least one of the amino acid sequences of SEQ ID NO's: 302-386;
  c) amino acid sequences that have 3, 2, or 1 amino acid difference with at least one of the amino acid sequences of SEQ ID NO's: 302-386;
and/or
CDR2 is chosen from the group consisting of:
  d) the amino acid sequences of SEQ ID NO's: 472-556;
  e) amino acid sequences that have at least 80% amino acid identity with at least one of the amino acid sequences of SEQ ID NO's: 472-556;
  f) amino acid sequences that have 3, 2, or 1 amino acid difference with at least one of the amino acid sequences of SEQ ID NO's: 472-556;
and/or
CDR3 is chosen from the group consisting of:
  g) the amino acid sequences of SEQ ID NO's: 642-726;
  h) amino acid sequences that have at least 80% amino acid identity with at least one of the amino acid sequences of SEQ ID NO's: 642-726;

i) amino acid sequences that have 3, 2, or 1 amino acid difference with at least one of the amino acid sequences of SEQ ID NO's: 642-726.

Such an amino acid sequence is preferably directed against IL-6R and/or an amino acid sequence that can specifically bind to IL-6R. Also, such an amino acid sequence is preferably an amino acid sequence according to any of the 133-161.

163. An amino acid sequence that essentially consists of 4 framework regions (FR1 to FR4, respectively) and 3 complementarity determining regions (CDR1 to CDR3, respectively), in which:
CDR1 is chosen from the group consisting of:
a) the amino acid sequences of SEQ ID NO's: 302-386;
b) amino acid sequences that have at least 80% amino acid identity with at least one of the amino acid sequences of SEQ ID NO's: 302-386;
c) amino acid sequences that have 3, 2, or 1 amino acid difference with at least one of the amino acid sequences of SEQ ID NO's: 302-386;
and
CDR2 is chosen from the group consisting of:
d) the amino acid sequences of SEQ ID NO's: 472-556;
e) amino acid sequences that have at least 80% amino acid identity with at least one of the amino acid sequences of SEQ ID NO's: 472-556;
f) amino acid sequences that have 3, 2, or 1 amino acid difference with at least one of the amino acid sequences of SEQ ID NO's: 472-556;
and
CDR3 is chosen from the group consisting of:
g) the amino acid sequences of SEQ ID NO's: 642-726;
h) amino acid sequences that have at least 80% amino acid identity with at least one of the amino acid sequences of SEQ ID NO's: 642-726;
i) amino acid sequences that have 3, 2, or 1 amino acid difference with at least one of the amino acid sequences of SEQ ID NO's: 642-726.

Such an amino acid sequence is preferably directed against IL-6R and/or an amino acid sequence that can specifically bind to IL-6R. Also, such an amino acid sequence is preferably an amino acid sequence according to any of the aspects 133-161.

164. An amino acid sequence according to any of aspects 162 to 163, in which the CDR sequences of said amino acid sequence have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 132-216.
Such an amino acid sequence is preferably directed against IL-6R and/or an amino acid sequence that can specifically bind to IL-6R. Also, such an amino acid sequence is preferably an amino acid sequence according to any of the aspects 133 to 161.

165. An amino acid sequence according to any of aspects 162 to 164 that is directed against IL-6R and that cross-blocks the binding of at least one of the amino acid sequences according to any of aspects the amino acid sequences of SEQ ID NO's: 132-216.

166. An amino acid sequence according to any of aspects 162 to 165 that is directed against IL-6R and that is cross-blocked from binding to IL-6R by at least one of the amino acid sequences of SEQ ID NO's: 132-216.

167. Amino acid sequence according to any of aspects 165 or 166 wherein the ability of said amino acid sequence to cross-block or to be cross-blocked is detected in a Biacore assay.

168. Amino acid sequence according to any of aspects 165 or 166 wherein the ability of said amino acid sequence to cross-block or to be cross-blocked is detected in an ELISA assay.

169. An amino acid sequence according to any of aspects 162 168, that is in essentially isolated form.

170. An amino acid sequence according to any of aspects 162 to 169, for administration to a subject, wherein said an amino acid sequence does not naturally occur in said subject.

171. An amino acid sequence according to any of aspects 162 to 170, that can specifically bind to IL-6R with a dissociation constant ($K_D$) of $10^{-5}$ to $10^{-12}$ moles/litre or less, and preferably $10^{-7}$ to $10^{-12}$ moles/litre or less and more preferably $10^{-8}$ to $10^{-12}$ moles/litre.

172. An amino acid sequence according to any of aspects 162 to 171, that can specifically bind to IL-6R with a rate of association ($k_{on}$-rate) of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$.

173. An amino acid sequence according to any of aspects 1621 to 172, that can specifically bind to IL-6R with a rate of dissociation ($k_{off}$ rate) between 1 $s^{-1}$ and $10^{-6}$ $s^1$ preferably between $10^{-2}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

174. An amino acid sequence according to any of aspects 162 to 173, that can specifically bind to IL-6R with an affinity less than 500 nM, preferably less than 200 nM, more preferably less than 10 nM, such as less than 500 µM.

175. An amino acid sequence according to any of aspects 162 to 174, that is a naturally occurring amino acid sequence (from any suitable species) or a synthetic or semi-synthetic amino acid sequence.

176. An amino acid sequence according to any of aspects 162 to 175, that comprises an immunoglobulin fold or that under suitable conditions is capable of forming an immunoglobulin fold.

177. An amino acid sequence according to any of aspects 162 to 176, that is an immunoglobulin sequence.

178. An amino acid sequence according to any of aspects 162 to 177, that is a naturally occurring immunoglobulin sequence (from any suitable species) or a synthetic or semi-synthetic immunoglobulin sequence.

179. An amino acid sequence according to any of aspects 162 to 178, that is a humanized immunoglobulin sequence, a camelized immunoglobulin sequence or an immunoglobulin sequence that has been obtained by techniques such as affinity maturation.

180. An amino acid sequence according to any of aspects 162 to 179, that essentially consists of a light chain variable domain sequence (e.g. a $V_L$-sequence); or of a heavy chain variable domain sequence (e.g. a $V_H$-sequence).

181. An amino acid sequence according to any of aspects 162 to 180, that essentially consists of a heavy chain variable domain sequence that is derived from a conventional four-chain antibody or that essentially consist of a heavy chain variable domain sequence that is derived from heavy chain antibody.

182. An amino acid sequence according to any of aspects 162 to 181, that essentially consists of a domain antibody (or an amino acid sequence that is suitable for use as a domain antibody), of a single domain antibody (or an amino acid sequence that is suitable for use as a single domain antibody), of a "dAb" (or an amino acid sequence that is suitable for use as a dAb) or of a Nanobody (including but not limited to a V$_{HH}$ sequence).

183. An amino acid sequence according to any of aspects 162 to 182, that essentially consists of a Nanobody.

184. An amino acid sequence according to any of aspects 162 to 183, that essentially consists of a Nanobody that
   i) has at least 80% amino acid identity with at least one of the amino acid sequences of SEQ ID NO's: 1 to 22, in which for the purposes of determining the degree of amino acid identity, the amino acid residues that form the CDR sequences are disregarded; and in which:
   ii) preferably one or more of the amino acid residues at positions 11, 37, 44, 45, 47, 83, 84, 103, 104 and 108 according to the Kabat numbering are chosen from the Hallmark residues mentioned in Table B-2.

185. An amino acid sequence according to any of aspects 162 to 184, that essentially consists of a Nanobody that
   i) has at least 80% amino acid identity with at least one of the amino acid sequences of SEQ ID NO's: 132-216, in which for the purposes of determining the degree of amino acid identity, the amino acid residues that form the CDR sequences are disregarded; and in which:
   ii) preferably one or more of the amino acid residues at positions 11, 37, 44, 45, 47, 83, 84, 103, 104 and 108 according to the Kabat numbering are chosen from the Hallmark residues mentioned in Table B-2.

186. An amino acid sequence according to any of aspects 162 to 185, that essentially consists of a humanized Nanobody.

187. Nanobody in which:
   CDR1 is chosen from the group consisting of:
      a) the amino acid sequences of SEQ ID NO's: 302-386;
      b) amino acid sequences that have at least 80% amino acid identity with at least one of the amino acid sequences of SEQ ID NO's: 302-386;
      c) amino acid sequences that have 3, 2, or 1 amino acid difference with at least one of the amino acid sequences of SEQ ID NO's: 302-386;
   and/or
   CDR2 is chosen from the group consisting of:
      d) the amino acid sequences of SEQ ID NO's: 472-556;
      e) amino acid sequences that have at least 80% amino acid identity with at least one of the amino acid sequences of SEQ ID NO's: 472-556;
      f) amino acid sequences that have 3, 2, or 1 amino acid difference with at least one of the amino acid sequences of SEQ ID NO's: 472-556;
   and/or
   CDR3 is chosen from the group consisting of:
      g) the amino acid sequences of SEQ ID NO's: 642-726;
      h) amino acid sequences that have at least 80% amino acid identity with at least one of the amino acid sequences of SEQ ID NO's: 642-726;
      i) amino acid sequences that have 3, 2, or 1 amino acid difference with at least one of the amino acid sequences of SEQ ID NO's: 642-726.

188. Nanobody according to aspect 187, in which:
   CDR1 is chosen from the group consisting of:
      a) the amino acid sequences of SEQ ID NO's: 302-386;
      b) amino acid sequences that have at least 80% amino acid identity with at least one of the amino acid sequences of SEQ ID NO's: 302-386;
      c) amino acid sequences that have 3, 2, or 1 amino acid difference with at least one of the amino acid sequences of SEQ ID NO's: 302-386;
   and
   CDR2 is chosen from the group consisting of:
      d) the amino acid sequences of SEQ ID NO's: 472-556;
      e) amino acid sequences that have at least 80% amino acid identity with at least one of the amino acid sequences of SEQ ID NO's: 472-556;
      f) amino acid sequences that have 3, 2, or 1 amino acid difference with at least one of the amino acid sequences of SEQ ID NO's: 472-556;
   and
   CDR3 is chosen from the group consisting of:
      g) the amino acid sequences of SEQ ID NO's: 642-726;
      h) amino acid sequences that have at least 80% amino acid identity with at least one of the amino acid sequences of SEQ ID NO's: 642-726;
      i) amino acid sequences that have 3, 2, or 1 amino acid difference with at least one of the amino acid sequences of SEQ ID NO's: 642-726.

189. Nanobody according to any of aspects 187 or 188, in which the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 132-216.

190. Nanobody according to any of aspects 187 to 189, which is a partially humanized Nanobody.

191. Nanobody according to any of aspects 187 to 190, which is a fully humanized Nanobody.

192. Nanobody according to any of aspects 187 to 191, that is chosen from the group consisting of SEQ ID NO's: 132-216 or from the group consisting of from amino add sequences that have more than 80%, preferably more than 90%, more preferably more than 95%, such as 99% or more sequence identity (as defined herein) with at least one of the amino acid sequences of SEQ ID NO's: 132-216.

193. Nanobody according to any of aspects 187 to 192, that is chosen from the group consisting of SEQ ID NO's: 132-216.

194. Nanobody directed against IL-6R that cross-blocks the binding of at least one of the amino acid sequences of SEQ ID NO's: 132-216 to IL-6R.

195. Nanobody directed against IL-6R that is cross-blocked from binding to IL-6R by at least one of the amino acid sequences of SEQ ID NO's: 132-216.

196. Nanobody according to any of aspects 194 or 195 wherein the ability of said Nanobody to cross-block or to be cross-blocked is detected in a Biacore assay.

197. Nanobody according to any of aspects 194 to 195 wherein the ability of said Nanobody to cross-block or to be cross-blocked is detected in an ELISA assay.

198. Polypeptide that comprises or essentially consists of one or more amino acid sequences according to any of aspects 133 to 186 and/or one or more Nanobodies according to any of aspects 187 to 197, and optionally further comprises one or more peptidic linkers.

199. Polypeptide according to aspect 198, in which said one or more binding units are immunoglobulin sequences.
200. Polypeptide according to any of aspects 198 or 199, in which said one or more other groups, residues, moieties or binding units are chosen from the group consisting of domain antibodies, amino acid sequences that are suitable for use as a domain antibody, single domain antibodies, amino acid sequences that are suitable for use as a single domain antibody, "dAb"'s, amino acid sequences that are suitable for use as a dAb, or Nanobodies.
201. Polypeptide according to any of aspects 198 to 200, in which said one or more amino acid sequences of the invention are immunoglobulin sequences.
202. Polypeptide according to any of aspects 198 to 201, in which said one or more amino acid sequences of the invention are chosen from the group consisting of domain antibodies, amino acid sequences that are suitable for use as a domain antibody, single domain antibodies, amino acid sequences that are suitable for use as a single domain antibody, "dAb"'s, amino acid sequences that are suitable for use as a dAb, or Nanobodies.
203. Polypeptide according to any of aspects 198 to 202, that comprises or essentially consists of one or more Nanobodies according to any of aspects 187 to 197 and in which said one or more other binding units are Nanobodies.
204. Polypeptide according to any of aspects 198 to 203, which is a multivalent construct.
205. Polypeptide according to any of aspects 198 to 204, which is a multiparatopic construct.
206. Polypeptide according to any of aspects 198 to 205, which is a multispecific construct.
207. Polypeptide according to any of aspects 198 to 206, which has an increased half-life, compared to the corresponding amino acid sequence according to any of aspects 133 to 186 per se or Nanobody according to any of aspects 187 to 197 per se, respectively.
208. Polypeptide according to aspect 207, in which said one or more other binding units provide the polypeptide with increased half-life, compared to the corresponding amino acid sequence according to any of aspects 133 to 186 per se or Nanobody according to any of aspects 187 to 197 per se, respectively.
209. Polypeptide according to aspect 207 or 208, in which said one or more other binding units that provide the polypeptide with increased half-life is chosen from the group consisting of serum proteins or fragments thereof, binding units that can bind to serum proteins, an Fc portion, and small proteins or peptides that can bind to serum proteins.
210. Polypeptide according to any of aspects 207 to 209, in which said one or more other binding units that provide the polypeptide with increased half-life is chosen from the group consisting of human serum albumin or fragments thereof.
211. Polypeptide according to any of aspect 207 to 210, in which said one or more other binding units that provides the polypeptide with increased half-life are chosen from the group consisting of binding units that can bind to serum albumin (such as human serum albumin) or a serum immunoglobulin (such as IgG).
212. Polypeptide according to any of aspects 207 to 211, in which said one or more other binding units that provides the polypeptide with increased half-life are chosen from the group consisting of domain antibodies, amino acid sequences that are suitable for use as a domain antibody, single domain antibodies, amino acid sequences that are suitable for use as a single domain antibody, "dAb"'s, amino acid sequences that are suitable for use as a dAb, or Nanobodies that can bind to serum albumin (such as human serum albumin) or a serum immunoglobulin (such as IgG),
213. Polypeptide according to aspect 207 to 212, in which said one or more other binding units that provides the polypeptide with increased half-life is a Nanobody that can bind to serum albumin (such as human serum albumin) or a serum immunoglobulin (such as IgG).
214. Polypeptide according to any of aspects 207 to 213, that has a serum half-life that is at least 1.5 times, preferably at least 2 times, such as at least 5 times, for example at least 10 times or more than 20 times, greater than the half-life of the corresponding amino acid sequence according to any of aspects 133 to 186 per se or Nanobody according to any of aspects 187 to 197 per se, respectively.
215. Polypeptide according to any of aspects 207 to 214, that has a serum half-life that is increased with more than 1 hours, preferably more than 2 hours, more preferably more than 6 hours, such as more than 12 hours, or even more than 24, 48 or 72 hours, compared to the corresponding amino acid sequence according to any of aspects 133 to 186 per se or Nanobody according to any of aspects 187 to 197 per se, respectively.
216. Polypeptide according to any of aspects 198 to 215, that has a serum half-life in human of at least about 12 hours, preferably at least 24 hours, more preferably at least 48 hours, even more preferably at least 72 hours or more; for example, of at least 5 days (such as about 5 to 10 days), preferably at least 9 days (such as about 9 to 14 days), more preferably at least about 10 days (such as about 10 to 15 days), or at least about 11 days (such as about 11 to 16 days), more preferably at least about 12 days (such as about 12 to 18 days or more), or more than 14 days (such as about 14 to 19 days).
217. Compound or construct, that comprises or essentially consists of one or more polypeptides according to any of aspects 1 to 132, amino acid sequences according to any of aspects 133 to 186 and/or one or more Nanobodies according to any of aspects 187 to 197, and optionally further comprises one or more other groups, residues, moieties or binding units, optionally linked via one or more linkers.
218. Compound or construct according to aspect 217, in which said one or more other groups, residues, moieties or binding units are amino acid sequences.
219. Compound or construct according to aspect 217 or 218, in which said one or more linkers, if present, are one or more amino acid sequences.
220. Compound or construct according to any of aspects 217 to 219, in which said one or more other groups, residues, moieties or binding units are immunoglobulin sequences.
221. Compound or construct according to any of aspects 217 to 220, in which said one or more other groups, residues, moieties or binding units are chosen from the group consisting of domain antibodies, amino acid sequences that are suitable for use as a domain antibody, single domain antibodies, amino acid sequences that are suitable for use as a single domain antibody, "dAb"'s, amino acid sequences that are suitable for use as a dAb, or Nanobodies.
222. Compound or construct according to any of aspects 217 to 221, in which said one or more amino acid sequences are immunoglobulin sequences.

223. Compound or construct according to any of aspects 217 to 222, in which said one or more amino acid sequences are chosen from the group consisting of domain antibodies, amino acid sequences that are suitable for use as a domain antibody, single domain antibodies, amino acid sequences that are suitable for use as a single domain antibody, "dAb"'s, amino acid sequences that are suitable for use as a dAb, or Nanobodies.

224. Compound or construct, that comprises or essentially consists of one or more Nanobodies according to any of aspects 187 to 197 and in which said one or more other groups, residues, moieties or binding units are Nanobodies.

225. Compound or construct according to any of aspects 217 to 224, which is a multivalent construct.

226. Compound or construct according to any of aspects 217 to 225, which is a multispecific construct.

227. Compound or construct according to any of aspects 217 to 226, which is a mutliparatopic construct.

228. Compound or construct according to any of aspects 217 to 227, which has an increased half-life, compared to the corresponding polypeptide according to any of aspects 1 to 132 per se, amino acid sequence according to any of aspects 133 to 186 per se or Nanobody according to any of aspects 187 to 197 per se, respectively.

229. Compound or construct according to aspect 217 to 228, in which said one or more other groups, residues, moieties or binding units provide the compound or construct with increased half-life, compared to the corresponding polypeptide according to any of aspects 1 to 132 per se, amino acid sequence according to any of aspects 133 to 186 per se or Nanobody according to any of aspects 187 to 197 per se, respectively.

230. Compound or construct according to aspect 229, in which said one or more other groups, residues, moieties or binding units that provide the compound or construct with increased half-life is chosen from the group consisting of serum proteins or fragments thereof, binding units that can bind to serum proteins, an Fc portion, and small proteins or peptides that can bind to serum proteins.

231. Compound or construct according to aspect 229 or 230, in which said one or more other groups, residues, moieties or binding units that provide the compound or construct with increased half-life is chosen from the group consisting of human serum albumin or fragments thereof.

232. Compound or construct according to any of aspects 229 to 231, in which said one or more other groups, residues, moieties or binding units that provides the compound or construct with increased half-life are chosen from the group consisting of binding units that can bind to serum albumin (such as human serum albumin) or a serum immunoglobulin (such as IgG).

233. Compound or construct according to any of aspects 229 to 232, in which said one or more other groups, residues, moieties or binding units that provides the compound or construct with increased half-life are chosen from the group consisting of domain antibodies, amino acid sequences that are suitable for use as a domain antibody, single domain antibodies, amino acid sequences that are suitable for use as a single domain antibody, "dAb"'s, amino acid sequences that are suitable for use as a dAb, or Nanobodies that can bind to serum albumin (such as human serum albumin) or a serum immunoglobulin (such as IgG).

234. Compound or construct according to any of aspects 229 to 233, in which said one or more other groups, residues, moieties or binding units that provides the compound or construct with increased half-life is a Nanobody that can bind to serum albumin (such as human serum albumin) or a serum immunoglobulin (such as IgG).

235. Compound or construct according to any of aspects 229 to 234, that has a serum half-life that is at least 1.5 times, preferably at least 2 times, such as at least 5 times, for example at least 10 times or more than 20 times, greater than the half-life of the corresponding polypeptide according to any of aspects 1 to 132 per se, amino acid sequence according to any of aspects 133 to 186 per se or Nanobody according to any of aspects 187 to 197 per se, respectively.

236. Compound or construct according to any of aspects 229 to 235, that has a serum half-life that is increased with more than 1 hours, preferably more than 2 hours, more preferably more than 6 hours, such as more than 12 hours, or even more than 24, 48 or 72 hours, compared to the corresponding polypeptide according to any of aspect 1 to 132 per se, amino acid sequence according to any of aspects 133 to 186 per se or Nanobody according to any of aspects 187 to 197 per se, respectively.

237. Compound or construct according to any of aspects 229 to 236, that has a serum half-life in human of at least about 12 hours, preferably at least 24 hours, more preferably at least 48 hours, even more preferably at least 72 hours or more; for example, of at least 5 days (such as about 5 to 10 days), preferably at least 9 days (such as about 9 to 14 days), more preferably at least about 10 days (such as about 10 to 15 days), or at least about 11 days (such as about 11 to 16 days), more preferably at least about 12 days (such as about 12 to 18 days or more), or more than 14 days (such as about 14 to 19 days).

238. Monovalent construct, comprising or essentially consisting of one amino acid sequence according to any of 133 to 186 and/or one Nanobody according to any of aspects 187 to 197.

239. Monovalent construct according to aspect 238, in which said amino acid sequence is chosen from the group consisting of domain antibodies, amino acid sequences that are suitable for use as a domain antibody, single domain antibodies, amino acid sequences that are suitable for use as a single domain antibody, "dAb"'s, amino acid sequences that are suitable for use as a dAb, or Nanobodies.

240. Monovalent construct, comprising or essentially consisting of one Nanobody according to any of aspects 187 to 197.

241. Monovalent construct, that is chosen from the group consisting of SEQ ID NO's: 132-216 or from the group consisting of amino acid sequences that have more than 80%, preferably more than 90%, more preferably more than 95%, such as 99% or more sequence identity (as defined herein) with at least one of the amino acid sequences of SEQ ID NO's: 132-216.

242. Use of a monovalent construct according to any of aspects 238 to 241, in preparing a multivalent polypeptide according to any of aspects 1 to 132 or 198 to 216 and/or a multivalent compound or construct according to any of aspects 217 to 237.

243. Use of a monovalent construct according to aspect 242, in preparing a multiparatopic polypeptide such as a biparatopic polypeptide or a multiparatopic construct such as a biparatopic construct.

244. Use of a monovalent construct according to any of aspects 242 or 243, wherein the monovalent construct is used as a binding domain or binding unit in preparing a multivalent construct comprising two or more binding units.

245. Use of a monovalent construct according to any of aspects 242 to 244, in preparing a multivalent construct that exhibits intramolecular binding compared to intermolecular binding.

246. Use of a monovalent construct according to any of aspects 242 to 245, as a binding domain or binding unit in preparing a multivalent construct, wherein the binding domains or binding units are linked via a linker such that the multivalent construct preferably exhibits intramolecular binding compared to intermolecular binding.

247. Use of a monovalent construct according to any of aspects 242 to 246, wherein the monovalent construct is directed against the IL-6 binding site on IL-6R and/or is capable of competing with IL-6 for binding to IL-6R.

248. Use of a monovalent construct according to any of aspects 242 to 246, wherein the monovalent construct is directed against one or more of the 18 contact residues as described in Boulanger et al. 2003 (Science 300, 2101-2104) present in the extracellular D3 domain of the IL-6R.

249. Use of a monovalent construct according to any of aspects 242 to 246, wherein the monovalent construct is directed against amino acid residues Phe229 and Phe279 present in the extracellular D3 domain of the IL-6R.

250. Use of a monovalent construct according to any of aspects 242 to 246, wherein the monovalent construct is directed against the gp130 binding site on IL-6R and/or the IL-6/IL-6R complex.

251. Use of a monovalent construct according to any of aspects 242 to 246, wherein the monovalent construct is directed against the Tocilizumab (MRA) binding site on IL-6R and/or is capable of competing with Tocilizumab (MRA) for binding to IL-6R.

252. Use of a monovalent construct according to any of aspects 242 to 246, wherein the monovalent construct is directed against the binding site for the reference IgG and the reference Fab on IL-6R and/or is capable of competing with the reference IgG and the reference Fab for binding to 1 L-6R.

253. Use of a monovalent construct according to any of aspects 242 to 246, wherein the monovalent construct is directed against the M182 binding site on IL-6R and/or is capable of competing with M182 for binding to IL-6R.

254. Use of a monovalent construct according to any of aspects 242 to 246, wherein the monovalent construct is directed against the BN-12 binding site on IL-6R and/or is capable of competing with BN-12 for binding to IL-6R.

255. Use of two monovalent constructs according to any of aspects 242 to 246, wherein a first monovalent construct is directed against the IL-6 binding site on IL-6R (and in particular against one or more of the 18 contact residues as described in Boulanger et al. 2003 (Science 300, 2101-2104) present in the extracellular D3 domain of the IL-6R, more particularly against amino acid residues Phe229 and Phe279 present in the extracellular D3 domain of the IL-6R) and/or is capable of competing with IL-6 for binding to IL-6R and wherein the second monovalent construct is directed against the gp130 binding site on IL-6R and/or the IL-6/IL-6R complex and/or is capable of competing with gn130 for binding to the IL-6/IL-6R complex.

256. Use of two monovalent constructs according to any of aspects 242 to 246, wherein a first monovalent construct is directed against the IL-6 binding site on IL-6R (and in particular against one or more of the 18 contact residues as described in Boulanger et al. 2003 (Science 300, 2101-2104) present in the extracellular D3 domain of the IL-6R, more particularly against amino acid residues Phe229 and Phe279 present in the extracellular D3 domain of the IL-6R) and/or is capable of competing with IL-6 for binding to IL-6R and wherein the second monovalent construct is directed against the M182 binding site on IL-6R and/or is capable of competing with M182 for binding to IL-6R.

257. Use of two monovalent constructs according to any of aspects 242 to 246, wherein a first monovalent construct is directed against the IL-6 binding site on IL-6R (and in particular against one or more of the 18 contact residues as described in Boulanger et al. 2003 (Science 300, 2101-2104) present in the extracellular D3 domain of the IL-6R, more particularly against amino acid residues Phe229 and Phe279 present in the extracellular D3 domain of the IL-6R) and/or is capable of competing with IL-6 for binding to IL-6R and wherein the second monovalent construct is directed against the BN-12 binding site on IL-6R and/or is capable of competing with BN-12 for binding to IL-6R.

258. Use of two monovalent constructs according to any of aspects 242 to 246, wherein a first monovalent construct is directed against the Tocilizumab (MRA) binding site on IL-6R and/or is capable of competing with Tocilizumab (MRA) for binding to IL-6R and wherein the second monovalent construct is directed against the gp130 binding site on IL-6R and/or the IL-6/IL-6R complex and/or is capable of competing with gp130 for binding to the IL-6/IL-6R complex.

259. Use of two monovalent constructs according to any of aspects 242 to 246, wherein a first monovalent construct is directed against the Tocilizumab (MRA) binding site on IL-6R and/or is capable of competing with Tocilizumab (MRA) for binding to IL-6R and wherein the second monovalent construct is directed against the M182 binding site on IL-6R and/or is capable of competing with M182 for binding to IL-6R.

260. Use of two monovalent constructs according to any of aspects 242 to 246, wherein a first monovalent construct is directed against the Tocilizumab (MRA) binding site on IL-6R and/or is capable of competing with Tocilizumab (MRA) for binding to IL-6R and wherein the second monovalent construct is directed against the BN-12 binding site on IL-6R and/or is capable of competing with BN-12 for binding to IL-6R.

261. Use of two monovalent constructs according to any of aspects 242 to 246, wherein a first monovalent construct is directed against the binding site for the reference IgG and the reference Fab on IL-6R and/or is capable of competing with the reference IgG and the reference Fab for binding to IL-6R and wherein the second monovalent construct is directed against the gp130 binding site on IL-6R and/or the IL-6/IL-6R complex and/or is capable of competing with gp130 for binding to the IL-6/IL-6R complex.

262. Use of two monovalent constructs according to any of aspects 242 to 246, wherein a first monovalent construct is directed against the binding site for the reference IgG and the reference Fab on IL-6R and/or is capable of competing with the reference IgG and the reference Fab for binding to IL-6R and wherein the second monovalent construct is directed against the M182 binding site on IL-6R and/or is capable of competing with M182 for binding to IL-6R.

263. Use of two monovalent constructs according to any of aspects 242 to 246, wherein a first monovalent construct is directed against the binding site for the reference IgG and the reference Fab on IL-6R and/or is capable of competing with the reference IgG and the reference Fab for binding to IL-6R and wherein the second monovalent construct is directed against the BN-12 binding site on IL-6R and/or is capable of competing with BN-12 for binding to IL-6R.

264. Use of two monovalent constructs according to any of aspects 242 to 246, wherein a first monovalent construct is directed against BN-12 binding site on IL-6R and/or is capable of competing with BN-12 for binding to IL-6R and wherein the second monovalent construct is directed against the gp130 binding site on IL-6R and/or the IL-6/IL-6R complex and/or is capable of competing with gp130 for binding to the IL-6/IL-6R complex.

265. Use of two monovalent constructs according to any of aspects 242 to 246, wherein a first monovalent construct is directed against the BN-12 binding site on IL-6R and/or is capable of competing with BN-12 for binding to IL-6R and wherein the second monovalent construct is directed against the M182 binding site on IL-6R and/or is capable of competing with M182 for binding to IL-6R.

266. Nucleic acid or nucleotide sequence, that encodes an amino acid sequence according to any of aspects 133 to 186, a Nanobody according to any of aspects 187 to 197, a polypeptide according to any of aspects 1 to 132 and 198 to 216, a compound or construct according to any of aspects 217 to 237 that is such that it can be obtained by expression of a nucleic acid or nucleotide sequence encoding the same, or a monovalent construct according to any of aspects 238 to 241.

267. Nucleic acid or nucleotide sequence according to aspect 266, that is in the form of a genetic construct.

268. Use of a nucleic acid or nucleotide sequence according to aspect 266, that encodes a monovalent construct according to any of aspects 238 to 241, for the preparation of a genetic construct that encodes a multivalent polypeptide according to any of aspects 1 to 132 and 198 to 216 or a multivalent construct according to any of aspects 217 to 237.

269. Use of a nucleic acid or nucleotide sequence according to aspect 268, wherein the genetic construct encodes a multiparatopic (such as a biparatopic) construct.

270. Method for preparing and/or generating a multiparatopic (such as e.g. biparatopic, triparatopic, etc.) polypeptide or construct according to any of aspects 1 to 132, said method comprising at least the steps of:
   a) providing a nucleic acid sequence according to aspect 266, encoding a first IL-6R binding amino acid sequence, fused to a set, collection or library of nucleic acid sequences encoding amino acid sequences;
   b) screening said set, collection or library of nucleic acid sequences for nucleic acid sequences that encode a second amino acid sequence that can bind to and/or has affinity for an antigenic determinant on IL-6R different from the antigenic determinant recognized by the first IL-6R binding amino acid sequence;
   and
   c) isolating the nucleic acid sequence encoding an IL-6R binding amino acid sequence fused to the nucleic acid sequence obtained in b), followed by expressing the encoded construct.

271. Method for preparing and/or generating a multiparatopic (such as e.g. biparatopic, triparatopic, etc.) polypeptide or construct according to any of aspects 1 to 132, said method comprising at least the steps of:
   a) providing a set, collection or library of nucleic acid sequences, in which each nucleic acid sequence in said set, collection or library encodes a fusion protein that comprises a first amino acid sequence that can bind to and/or has affinity for a first antigenic determinant, part, domain or epitope on IL-6R that is fused (optionally via a linker sequence) to a second amino acid sequence, in which essentially each second amino acid sequence (or most of these) is a different member of a set, collection or library of different amino acid sequences;
   b) screening said set, collection or library of nucleic acid sequences for nucleic acid sequences that encode an amino acid sequence that can bind to and/or has affinity for a second antigenic determinant, part, domain or epitope on IL-6R different from the first antigenic determinant, part, domain or epitope on IL-6R;
   and
   c) isolating the nucleic acid sequences that encode an amino acid sequence that can bind to and/or has affinity for a second antigenic determinant, part, domain or epitope on IL-6R different from the first antigenic determinant, part, domain or epitope on IL-6R, obtained in b), optionally followed by expressing the encoded amino acid sequence.

272. Method according to aspect 271, wherein the first amino acid is also encoded by a set, collection or library of nucleic acid sequences and wherein, in step b), said set, collection or library of nucleic acid sequences is screened for nucleic acid sequences that encode an amino acid sequence that can bind to and/or has affinity for the first antigenic determinant, part, domain or epitope on IL-6R.

273. Method according to aspect 272, wherein the screening in step b) is performed in a single step.

274. Method according to aspect 272, wherein the screening in step b) is performed in subsequent steps.

275. Method according to any of aspects 270 to 274, wherein the first amino acid sequence used in step a) is preferably such that (i) it can bind to and/or has affinity for the IL-6 binding site on IL-6R (and in particular against one or more of the 18 contact residues as described in Boulanger et al. 2003 (Science 300, 2101-2104) present in the extracellular D3 domain of the IL-6R, more particularly against amino acid residues Phe229 and Phe279 present in the extracellular 03 domain of the IL-6R) and/or (ii) competes with IL-6 for binding to IL-6R.

276. Method according to any of aspects 270 to 274, wherein the first amino acid sequence used in step a) is preferably such that (i) it can bind to and/or has affinity for the Tocilizumab (MRA) binding site on IL-6R and/or (ii) competes with Tocilizumab (MRA) for binding to IL-6R.

277. Method according to any of aspects 270 to 274, wherein the first amino acid sequence used in step a) is preferably such that (i) it can bind to and/or has affinity for the binding site for the reference IgG and the reference Fab on IL-6R and/or (ii) competes with the reference IgG and the reference Fab for binding to IL-6R.

278. Method according to any of aspects 270 to 277, wherein in step b), the set, collection or library of nucleic acid sequences is screened for nucleic acid sequences that encode (i) an amino acid sequence that can bind to and/or has affinity for the gp130 binding site on IL-6R and/or the IL-6/IL-6R complex and/or (ii) an amino acid sequence that can compete with gp130 for binding to the IL-6/IL-6R complex.

279. Method according to any of aspects 270 to 277, wherein in step b), the set, collection or library of nucleic acid sequences is screened for nucleic acid sequences that encode (i) an amino acid sequence that can bind to and/or has affinity for the M182 binding site on IL-6R and/or (ii) an amino acid sequence that can compete with M182 for binding to IL-6R.

280. Method according to any of aspects 270 to 277, wherein in step b), the set, collection or library of nucleic acid sequences is screened for nucleic acid sequences that encode (i) an amino acid sequence that can bind to and/or has affinity for the BN-12 binding site on IL-6R and/or (ii) an amino acid sequence that can compete with BN-12 for binding to IL-6R.

281. Method according to any of aspects 270 to 274, wherein the first amino acid sequence used in step a) is preferably such that (i) it can bind to and/or has affinity for the gp130 binding site on IL-6R and/or the IL-6/IL-6R complex and/or (ii) an amino acid sequence that can compete with gp130 for binding to the IL-6/IL-6R complex.

282. Method according to any of aspects 270 to 274, wherein the first amino acid sequence used in step a) is preferably such that (1) it can bind to and/or has affinity for the M182 binding site on IL-6R and/or (ii) an amino acid sequence that can compete with M182 for binding to IL-6R.

283. Method according to any of aspects 270 to 274 or 281 to 282, wherein in step b), the set, collection or library of nucleic acid sequences is screened for nucleic acid sequences that encode (i) an amino acid sequence that can bind to and/or has affinity for the IL-6 binding site on IL-6R (and in particular against one or more of the 18 contact residues as described in Boulanger et al. 2003 (Science 300, 2101-2104) present in the extracellular D3 domain of the IL-6R, more particularly against amino acid residues Phe229 and Phe279 present in the extracellular D3 domain of the IL-6R) and/or (ii) competes with IL-6 for binding to IL-6R.

284. Method according to any of aspects 270 to 274 or 281 to 282, wherein in step b), the set, collection or library of nucleic acid sequences is screened for nucleic acid sequences that encode (i) an amino acid sequence that can bind to and/or has affinity for the Tocilizumab (MRA) binding site on IL-6R and/or (ii) competes with Tocilizumab (MRA) for binding to IL-6R.

285. Method according to any of aspects 270 to 274 or 281 to 282, wherein in step b), the set, collection or library of nucleic acid sequences is screened for nucleic acid sequences that encode (i) an amino acid sequence that can bind to and/or has affinity for the binding site for the reference IgG and the reference Fab on IL-6R and/or (ii) competes with the reference IgG and the reference Fab for binding to IL-6R.

286. Method according to any of aspects 270 to 274 or 281 to 282, wherein in step b), the set, collection or library of nucleic acid sequences is screened for nucleic acid sequences that encode (i) an amino acid sequence that can bind to and/or has affinity for the BN-12 binding site on IL-6R and/or (ii) competes with BN-12 for binding to IL-6R.

287. Method according to any of aspects 270 to 274, wherein in step b), the set, collection or library of nucleic acid sequences is screened for nucleic acid sequences that both (i) encode an amino acid sequence that can bind to and/or has affinity for the IL-6 binding site on IL-6R (and in particular against one or more of the 18 contact residues as described in Boulanger et al. 2003 (Science 300, 2101-2104) present in the extracellular D3 domain of the IL-6R, more particularly against amino acid residues Phe229 and Phe279 present in the extracellular D3 domain of the IL-6R) and/or (ii) competes with IL-6 for binding to IL-6R and that also (ii) encode an amino acid sequence that can bind to and/or has affinity for the gp130 binding site on IL-6R and/or the IL-6/IL-6R complex and/or (ii) an amino acid sequence that can compete with gp130 for binding to the IL-6/IL-6R complex.

288. Method according to any of aspects 270 to 274, wherein in step b), the set, collection or library of nucleic acid sequences is screened for nucleic acid sequences that both (i) encode an amino acid sequence that can bind to and/or has affinity for the IL-6 binding site on IL-6R (and in particular against one or more of the 18 contact residues as described in Boulanger et al. 2003 (Science 300, 2101-2104) present in the extracellular D3 domain of the IL-6R, more particularly against amino acid residues Phe229 and Phe279 present in the extracellular D3 domain of the IL-6R) and/or (ii) competes with IL-6 for binding to IL-6R and that also (ii) encode an amino acid sequence that can bind to and/or has affinity for the M182 binding site on IL-6R and/or (ii) an amino acid sequence that can compete with M182 for binding to IL-6R.

289. Method according to any of aspects 270 to 274, wherein in step b), the set, collection or library of nucleic acid sequences is screened for nucleic acid sequences that both (i) encode an amino acid sequence that can bind to and/or has affinity for the IL-6 binding site on IL-6R (and in particular against one or more of the 18 contact residues as described in Boulanger et al. 2003 (Science 300, 2101-2104) present in the extracellular D3 domain of the IL-6R, more particularly against amino acid residues Phe229 and Phe279 present in the extracellular D3 domain of the IL-6R) and/or (ii) competes with IL-6 for binding to IL-6R and that also (ii) encode an amino acid sequence that can bind to and/or has affinity for the BN-12 binding site on IL-6R and/or (ii) an amino acid sequence that can compete with BN-12 for binding to IL-6R.

290. Method according to any of aspects 270 to 274, wherein in step b), the set, collection or library of nucleic acid sequences is screened for nucleic acid sequences that both (i) encode an amino acid sequence that can bind to and/or has affinity for the Tocilizumab (MRA) binding site on IL-BR and/or (ii) competes with Tocilizumab (MRA) for binding to IL-6R and that also (ii) encode an amino acid sequence that can bind to and/or has affinity for the gp130 binding site on IL-6R and/or the IL-6/IL-6R complex and/or (ii) an amino acid sequence that can compete with gp130 for binding to the IL-6/IL-6R complex.

291. Method according to any of aspects 270 to 274, wherein in step b), the set, collection or library of nucleic acid sequences is screened for nucleic acid sequences that both (i) encode an amino acid sequence that can bind to and/or has affinity for the Tocilizumab (MRA) binding site on IL-6R and/or (ii) competes with Tocilizumab (MRA) for binding to IL-6R and that also (ii) encode an amino acid sequence that can bind to and/or has affinity for the M182 binding site on IL-6R and/or (ii) an amino acid sequence that can compete with M182 for binding to IL-6R.

292. Method according to any of aspects 270 to 274, wherein in step b), the set, collection or library of nucleic acid sequences is screened for nucleic acid sequences that both (i) encode an amino acid sequence that can bind to and/or has affinity for the Tocilizumab (MRA) binding site on IL-6R and/or (ii) competes with Tocilizumab (MRA) for binding to IL-6R and that also (ii) encode an amino acid sequence that can bind to and/or has affinity for the BN-12 binding site on IL-6R and/or (ii) an amino acid sequence that can compete with BN-12 for binding to IL-6R.

293. Method according to any of aspects 270 to 274, wherein in step b), the set, collection or library of nucleic acid sequences is screened for nucleic acid sequences that both (i) encode an amino acid sequence that can bind to and/or has affinity for the binding site for the reference IgG and the reference Fab on IL-6R and/or (ii) competes with the reference IgG and the reference Fab for binding to IL-6R and that also (ii) encode an amino acid sequence that can bind to and/or has affinity for the gp130 binding site on IL-6R and/or the IL-6/IL-6R complex and/or (ii) an amino acid sequence that can compete with gp130 for binding to the IL-6/IL-6R complex.

294. Method according to any of aspects 270 to 274, wherein in step b), the set, collection or library of nucleic acid sequences is screened for nucleic acid sequences that both (i) encode an amino acid sequence that can bind to and/or has affinity for the binding site for the reference IgG and the reference Fab on IL-6R and/or (ii) competes with the reference IgG and the reference Fab for binding to IL-6R and that also (ii) encode an amino acid sequence that can bind to and/or has affinity for the M182 binding site on IL-6R and/or (ii) an amino acid sequence that can compete with M182 for binding to IL-6R.

295. Method according to any of aspects 270 to 274, wherein in step b), the set, collection or library of nucleic acid sequences is screened for nucleic acid sequences that both (i) encode an amino acid sequence that can bind to and/or has affinity for the binding site for the reference IgG and the reference Fab on IL-6R and/or (ii) competes with the reference IgG and the reference Fab for binding to IL-6R and that also (ii) encode an amino acid sequence that can bind to and/or has affinity for the BN-12 binding site on IL-6R and/or (ii) an amino acid sequence that can compete with BN-12 for binding to IL-6R.

296. Method according to any of aspects 270 to 274, wherein in step b), the set, collection or library of nucleic acid sequences is screened for nucleic acid sequences that both (i) encode an amino acid sequence that can bind to and/or has affinity for the BN-12 binding site on IL-6R (and in particular against one or more of the 18 contact residues as described in Boulanger et al. 2003 (Science 300, 2101-2104) present in the extracellular D3 domain of the IL-6R, more particularly against amino acid residues Phe229 and Phe279 present in the extracellular D3 domain of the IL-6R) and/or (ii) competes with BN-12 for binding to IL-6R and that also (ii) encode an amino acid sequence that can bind to and/or has affinity for the M182 binding site on IL-6R and/or (ii) an amino acid sequence that can compete with M182 for binding to IL-6R.

297. Method according to any of aspects 287 to 296, wherein the screening in step b) is performed in a single step.

298. Method according to aspect 287 to 296, wherein the screening in step b) is performed in subsequent steps.

299. Method according to any of aspects 287 to 298, wherein the screening in step b) is performed in the presence of IL-6, Tocilizumab (MRA), gp130, M182 and/or BN-12.

300. Method for screening for suitable and/or optimal linker lengths for linking a first and a second amino acid sequence in a multiparatopic (such as e.g. biparatopic, triparatopic, etc.) polypeptide or construct according to any of aspects 1 to 132, wherein said method comprises at least the steps of:
   a) providing a set, collection or library of nucleic acid sequences, in which each nucleic acid sequence in said set, collection or library encodes a fusion protein that comprises a first amino acid sequence that can bind to and/or has affinity for a first antigenic determinant, part, domain or epitope on IL-6R that is fused via a linker sequence to a second amino acid sequence that has can bind to and/or has affinity for a second antigenic determinant, part, domain or epitope on IL-6R (which may be the same or different as the first antigenic determinant, part, domain or epitope on IL-6), in which essentially each nucleic acid sequence (or most of these) encodes a fusion protein with a different linker sequence so as to provide a set, collection or library encoding different fusion proteins;
   b) screening said set, collection or library of nucleic acid sequences for nucleic acid sequences that encode an amino acid sequence that can bind to and/or has affinity for the first and second antigenic determinant, part, domain or epitope on IL-6R; and
   c) isolating the nucleic acid sequences that encode an amino acid sequence that can bind to and/or has affinity for the first and second antigenic determinant, part, domain or epitope on IL-6R, optionally followed by expressing the encoded amino acid sequence.

301. Method according to aspect 300, wherein the first amino acid sequence is an amino acid sequence that can bind to and/or has affinity for the IL-6 binding site on IL-6R and/or is capable of competing with IL-6 for binding to IL-6R.

302. Method according to aspect 300, wherein the first amino acid sequence is an amino acid sequence that can bind to and/or has affinity for the gp130 binding site on IL-6R and/or the IL-6/IL-6R complex and/or is capable of competing with gp130 for binding to the IL-6/IL-6R complex.

303. Method according to aspect 300, wherein the first amino acid sequence is an amino acid sequence that can bind to and/or has affinity for the Tocilizumab (MRA) binding site on IL-6R and/or is capable of competing with Tocilizumab (MRA) for binding to IL-6R.

304. Method according to aspect 300, wherein the first amino acid sequence is an amino acid sequence that can bind to and/or has affinity for the binding site for the reference IgG and the reference Fab on IL-6R and/or is capable of competing with the reference IgG and the reference Fab for binding to IL-6R.

305. Method according to aspect 300, wherein the first amino acid sequence is an amino acid sequence that can bind to and/or has affinity for the M182 binding site on IL-6R and/or is capable of competing with M182 for binding to IL-6R.

306. Method according to aspect 300, wherein the first amino acid sequence is an amino acid sequence that can bind to and/or has affinity for the BN-12 binding site on IL-6R and/or is capable of competing with BN-12 for binding to IL-6R.

307. Method according to aspect 300, wherein the first amino acid sequence is an amino acid sequence that can bind to and/or has affinity for the IL-6 binding site on IL-6R and/or is capable of competing with IL-6 for binding to IL-6R and the second amino acid sequence is directed against the gp130 binding site on IL-6R or the IL-6/IL-6R complex and/or is capable of competing with gp130 for binding to the IL-6/IL-6R complex (or visa versa).

308. Method according to aspect 300, wherein the first amino acid sequence is an amino acid sequence that can bind to and/or has affinity for the IL-6 binding site on IL-6R and/or is capable of competing with IL-6 for binding to IL-6R and the second amino acid sequence is directed against the M182 binding site on IL-6R and/or is capable of competing with M182 for binding to the IL-6R (or visa versa).
309. Method according to aspect 300, wherein the first amino acid sequence is an amino acid sequence that can bind to and/or has affinity for IL-6 binding site on IL-6R and/or is capable of competing with IL-6 for binding to IL-6R and the second amino acid sequence is directed against the BN-12 binding site on IL-6R and/or is capable of competing with BN-12 for binding to the IL-6R (or visa versa).
310. Method according to aspect 300, wherein the first amino acid sequence is an amino acid sequence that can bind to and/or has affinity for the Tocilizumab (MRA) binding site on IL-6R and/or is capable of competing with Tocilizumab (MRA) for binding to ft-6R and the second amino acid sequences is directed against the gp130 binding site on IL-6R and/or the IL-6/IL-6R complex and/or is capable of competing with gp130 for binding to the IL-6/IL-6R complex (or visa versa).
311. Method according to aspect 300, wherein the first amino acid sequence is an amino acid sequence that can bind to and/or has affinity for the Tocilizumab (MRA) binding site on IL-6R and/or is capable of competing with Tocilizumab (MRA) for binding to IL-6R and the second amino acid sequences is directed against the M182 binding site on IL-6R and/or is capable of competing with M182 for binding to the IL-6R (or visa versa).
312. Method according to aspect 300, wherein the first amino acid sequence is an amino acid sequence that can bind to and/or has affinity for the Tocilizumab (MRA) binding site on IL-6R and/or is capable of competing with Tocilizumab (MRA) for binding to IL-6R and the second amino acid sequences is directed against the BN-12 binding site on IL-6R and/or is capable of competing with BN-12 for binding to the IL-6R (or visa versa).
313. Method according to aspect 300, wherein the first amino acid sequence is an amino acid sequence that can bind to and/or has affinity for the binding site for the reference IgG and the reference Fab on IL-6R and/or is capable of competing with the reference IgG and the reference Fab for binding to IL-6R and the second amino acid sequences is directed against the gp130 binding site on IL-6R and/or the IL-6/IL-6R complex and/or is capable of competing with gp130 for binding to the IL-6/IL-6R complex (or visa versa).
314. Method according to aspect 300, wherein the first amino acid sequence is an amino acid sequence that can bind to and/or has affinity for the binding site for the reference IgG and the reference Fab on IL-6R and/or is capable of competing with the reference IgG and the reference Fab for binding to IL-6R and the second amino acid sequences is directed against the M182 binding site on IL-6R and/or is capable of competing with M182 for binding to the IL-6R (or visa versa).
315. Method according to aspect 300, wherein the first amino acid sequence is an amino acid sequence that can bind to and/or has affinity for the binding site for the reference IgG and the reference Fab on IL-6R and/or is capable of competing the reference IgG and the reference Fab for binding to IL-6R and the second amino acid sequences is directed against the BN-12 binding site on IL-6R and/or is capable of competing with BN-12 for binding to the IL-6R (or visa versa).
316. Method according to aspect 300, wherein the first amino acid sequence is an amino acid sequence that can bind to and/or has affinity for the BN-12 binding site on IL-6R and/or is capable of competing with BN-12 for binding to IL-6R and the second amino acid sequences is directed against the gp130 binding site on IL-6R or the IL-6/IL-6R complex and/or is capable of competing with gp130 for binding to the IL-6/IL-6R complex (or visa versa).
317. Method according to aspect 300, wherein the first amino acid sequence is an amino acid sequence that can bind to and/or has affinity for the BN-12 binding site on IL-6R and/or is capable of competing with BN-12 for binding to IL-6R and the second amino acid sequence is directed against the M182 binding site on IL-6R and/or is capable of competing with M182 for binding to the IL-6R (or visa versa).
318. Method according to any of aspects 300 to 317, wherein the screening in step b) is performed in a single step.
319. Method according to any of aspects 300 to 317, wherein the screening in step b) is performed in subsequent steps.
320. Method according to any of aspects 300 to 319, wherein the screening in step b) is performed in the presence of IL-6, Tocilizumab (MRA), gp130, M182 and/or BN-12.
321. Method for preparing and/or generating a multiparatopic (such as e.g. biparatopic, triparatopic, etc.) polypeptide or construct according to any of aspects 1 to 132, said method comprising at least the steps of:
 a) providing a set, collection or library of nucleic acid sequences encoding amino acid sequences;
 b) screening said set, collection or library of nucleic acid sequences for a set, collection or library of nucleic acid sequences that encode an amino acid sequence that can bind to and/or has affinity for IL-6R;
 c) ligating said set, collection or library of nucleic acid sequences that encode an amino acid sequence that can bind to and/or has affinity for IL-6R to another nucleic acid sequence that encodes an amino acid sequence that can bind to and/or has affinity for IL-6R (e.g. a nucleic acid sequence that encodes an amino acid sequence that competes with IL-6 for binding IL-6R);
 and
 d) from the set, collection or library of nucleic acid sequences obtained in c), isolating the nucleic acid sequences encoding a biparatopic amino acid sequence that can bind to and/or has affinity for IL-6R (and e.g. further selecting for nucleic acid sequences that encode a biparatopic amino acid sequence that antagonizes with higher potency compared to the monovalent amino acid sequences), followed by expressing the encoded amino acid sequence.
322. Method for preparing and/or generating multiparatopic (such as e.g. biparatopic, triparatopic, etc.) polypeptide or construct according to any of aspects 1 to 132, said method comprising at least the steps of:
 a) providing a first set, collection or library of nucleic acid sequences encoding amino acid sequences;
 b) screening said first set, collection or library of nucleic acid sequences for a nucleic acid sequence that encodes an amino acid sequence that can bind to and/or has affinity for a first antigenic determinant, part, domain or epitope on IL-6R;
 c) ligating the nucleic acid sequence encoding said amino acid sequence that can bind to and/or has affinity for a first antigenic determinant, part, domain or epitope on IL-6R obtained in b) to another set, collection or library of nucleic acid sequences encoding amino acid sequences to obtain a set, collection or library of nucleic acid sequences that encode fusion proteins;

d) screening said set, collection or library of nucleic acid sequences obtained in step c) for a nucleic acid sequence that encodes an amino acid sequence that can bind to and has affinity for a second antigenic determinant, part, domain or epitope on IL-6R which is the same or different from the first antigenic determinant, part, domain or epitope on IL-6R;

and e) isolating the nucleic acid sequence that encodes an amino acid sequence that can bind to and/or has affinity for the first and second antigenic determinant, part, domain or epitope on IL-6R, optionally followed by expressing the encoded amino acid sequence.

323. Method according to aspect 322, wherein in step b), the set, collection or library of nucleic acid sequences is screened for nucleic acid sequences that encode a first amino acid sequence that (i) can bind to and/or has affinity for the IL-6 binding site on IL-6R (and in particular against one or more of the 18 contact residues as described in Boulanger et al. 2003 (Science 300, 2101-2104) present in the extracellular D3 domain of the IL-6R, more particularly against amino acid residues Phe229 and Phe279 present in the extracellular D3 domain of the IL-6R) and/or (ii) competes with IL-6 for binding to IL-6R.

324. Method according to aspect 322, wherein in step b), the set, collection or library of nucleic acid sequences is screened for nucleic acid sequences that encode a first amino acid sequence that (i) can bind to and/or has affinity for the Tocilizumab (MRA) binding site on IL-6R and/or (ii) competes with Tocilizumab (MRA) for binding to IL-6R.

325. Method according to aspect 322, wherein in step b), the set, collection or library of nucleic acid sequences is screened for nucleic acid sequences that encode a first amino acid sequence that (i) can bind to and/or has affinity for the binding site for the reference IgG and the reference Fab on IL-6R and/or (ii) competes with the reference IgG and the reference Fab for binding to IL-6R.

326. Method according to aspect 322, wherein in step b), the set, collection or library of nucleic acid sequences is screened for nucleic acid sequences that encode a first amino acid sequence that (i) can bind to and/or has affinity for the BN-12 binding site on IL-6R and/or (ii) competes with BN-12 for binding to IL-6R.

327. Method according to any of aspect 322 to 326, wherein in step d), the set, collection or library of nucleic acid sequences is screened for nucleic acid sequences that encode a second amino acid sequence that (i) can bind to and/or has affinity for the gp 130 binding site on IL-6R and/or the IL-6/IL-6R complex and/or (ii) that can compete with gp130 for binding to the IL-6/IL-6R complex.

328. Method according to aspect 322 to 326, wherein in step d), the set, collection or library of nucleic acid sequences is screened for nucleic acid sequences that encode a second amino acid sequence that (i) can bind to and/or has affinity for the M182 binding site on IL-6R and/or (ii) that can compete with M182 for binding to IL-6R, 329. Method according to aspect 322 to 326, wherein in step d), the set, collection or library of nucleic acid sequences is screened for nucleic acid sequences that encode a second amino acid sequence that (i) can bind to and/or has affinity for the BN-12 binding site on IL-6R and/or (ii) that can compete with BN-12 for binding to IL-6R.

330. Method according to aspect 322, wherein in step b), the set, collection or library of nucleic acid sequences is screened for nucleic acid sequences that encode a first amino acid sequence that (i) can bind to and/or has affinity for the gp 130 binding site on IL-6R and/or the IL-6/IL-6R complex and/or (ii) that can compete with gp130 for binding to the IL-6/IL-6R complex.

331. Method according to aspect 322, wherein in step b), the set, collection or library of nucleic acid sequences is screened for nucleic acid sequences that encode a first amino acid sequence that (i) can bind to and/or has affinity for the M182 binding site on IL-6R and/or (ii) that can compete with M182 for binding to IL-6R.

332. Method according to aspect 322, wherein in step b), the set, collection or library of nucleic acid sequences is screened for nucleic acid sequences that encode a first amino acid sequence that (i) can bind to and/or has affinity for the BN-12 binding site on IL-6R and/or (ii) competes with BN-12 for binding to IL-6R.

333. Method according to aspect 322 or 330 to 332, wherein in step d), the set, collection or library of nucleic acid sequences is screened for nucleic acid sequences that encode a second amino acid sequence that (i) can bind to and/or has affinity for the IL-6 binding site on IL-6R (and in particular against one or more of the 18 contact residues as described in Boulanger et al. 2003 (Science 300, 2101-2104) present in the extracellular D3 domain of the IL-6R, more particularly against amino acid residues Phe229 and Phe279 present in the extracellular D3 domain of the IL-6R) and/or (ii) competes with IL-6 for binding to IL-6R.

334. Method according to aspect 322 or 330 to 332, wherein in step d), the set, collection or library of nucleic acid sequences is screened for nucleic acid sequences that encode a second amino acid sequence that (i) can bind to and/or has affinity for the Tocilizumab (MRA) binding site on IL-6R and/or (ii) competes with Tocilizumab (MRA) for binding to IL-6R.

335. Method according to aspect 322 or 330 to 332, wherein in step d), the set, collection or library of nucleic acid sequences is screened for nucleic acid sequences that encode a second amino acid sequence that (i) can bind to and/or has affinity for the binding site for the reference IgG and the reference Fab on IL-6R and/or (ii) competes with the reference IgG and the reference Fab for binding to IL-6R.

336. Method according to aspect 322 or 330 to 332, wherein in step d), the set, collection or library of nucleic acid sequences is screened for nucleic acid sequences that encode a second amino acid sequence that (i) can bind to and/or has affinity for the BN-12 binding site on IL-6R and/or (ii) that can compete with BN-12 for binding to IL-6R.

337. Method according to aspect 322, wherein in step b), the set, collection or library of nucleic acid sequences is screened nucleic acid sequences that encode a first amino acid sequence that (i) can bind to and/or has affinity for the IL-6 binding site on IL-6R (and in particular against one or more of the 18 contact residues as described in Boulanger et al. 2003 (Science 300, 2101-2104) present in the extracellular D3 domain of the IL-6R, more particularly against amino acid residues Phe229 and Phe279 present in the extracellular D3 domain of the IL-6R) and/or (ii) competes with IL-6 for binding to IL-6R and wherein in step d), the set, collection or library of nucleic acid sequences is screened for nucleic acid sequences that encode a second amino acid sequence that (i) can bind to and/or has affinity for the gp 130 binding site on IL-6R and/or the IL-6/IL-6R complex and/or (ii) that can compete with gp130 for binding to the IL-6/IL-6R complex (or visa versa).

338. Method according to aspect 322, wherein in step b), the set, collection or library of nucleic acid sequences is screened nucleic acid sequences that encode a first amino acid sequence that (i) can bind to and/or has affinity for the IL-6 binding site on IL-6R (and in particular against one or more of the 18 contact residues as described in Boulanger et al. 2003 (Science 300, 2101-2104) present in the extracellular D3 domain of the IL-6R, more particularly against amino acid residues Phe229 and Phe279 present in the extracellular D3 domain of the IL-6R) and/or (ii) competes with IL-6 for binding to IL-6R and wherein in step d), the set, collection or library of nucleic acid sequences is screened for nucleic acid sequences that encode a second amino acid sequence that (i) can bind to and/or has affinity for the M182 binding site on IL-6R and/or (ii) that can compete with M182 for binding to IL-6R (or visa versa).

339. Method according to aspect 322, wherein in step b), the set, collection or library of nucleic acid sequences is screened nucleic acid sequences that encode a first amino acid sequence that (i) can bind to and/or has affinity for the IL-6 binding site on IL-6R (and in particular against one or more of the 18 contact residues as described in Boulanger et al. 2003 (Science 300, 2101-2104) present in the extracellular D3 domain of the IL-6R, more particularly against amino acid residues Phe229 and Phe279 present in the extracellular D3 domain of the IL-6R) and/or (ii) competes with IL-6 for binding to IL-6R and wherein in step d), the set, collection or library of nucleic acid sequences is screened for nucleic acid sequences that encode a second amino acid sequence that (i) can bind to and/or has affinity for the BN-12 binding site on IL-6R and/or (ii) that can compete with BN-12 for binding to IL-6R (or visa versa).

340. Method according to aspect 322 wherein in step b), the set, collection or library of nucleic acid sequences is screened nucleic acid sequences that encode a first amino acid sequence that (i) can bind to and/or has affinity for the Tocilizumab (MRA) binding site on IL-6R and/or (ii) competes with Tocilizumab (MRA) for binding to IL-6R and wherein in step d), the set, collection or library of nucleic acid sequences is screened for nucleic acid sequences that encode a second amino acid sequence that (i) can bind to and/or has affinity for the gp 130 binding site on IL-6R and/or the IL-6/IL-6R complex and/or (ii) that can compete with gp130 for binding to the IL-6/IL-6R complex (or visa versa).

341. Method according to aspect 322, wherein in step b), the set, collection or library of nucleic acid sequences is screened nucleic acid sequences that encode a first amino acid sequence that (i) can bind to and/or has affinity for the Tocilizumab (MRA) binding site on IL-6R and/or (ii) competes with Tocilizumab (MRA) for binding to IL-6R and wherein in step d), the set, collection or library of nucleic acid sequences is screened for nucleic acid sequences that encode a second amino acid sequence that (i) can bind to and/or has affinity for the M182 binding site on IL-6R and/or (ii) that can compete with M182 for binding to IL-6R (or visa versa).

342. Method according to aspect 322, wherein in step b), the set, collection or library of nucleic acid sequences is screened nucleic acid sequences that encode a first amino acid sequence that (i) can bind to and/or has affinity for the Tocilizumab (MRA) binding site on IL-6R and/or (ii) competes with Tocilizumab (MRA) for binding to IL-6R and wherein in step d), the set, collection or library of nucleic acid sequences is screened for nucleic acid sequences that encode a second amino acid sequence that (i) can bind to and/or has affinity for the BN-12 binding site on IL-6R and/or (ii) that can compete with BN-12 for binding to IL-6R (or visa versa).

343. Method according to aspect 322 wherein in step b), the set, collection or library of nucleic acid sequences is screened nucleic acid sequences that encode a first amino acid sequence that (i) can bind to and/or has affinity for the binding site for the reference IgG and reference Fab on IL-6R and/or (ii) competes with the reference IgG and reference Fab for binding to IL-6R and wherein in step d), the set, collection or library of nucleic acid sequences is screened for nucleic acid sequences that encode a second amino acid sequence that (i) can bind to and/or has affinity for the gp 130 binding site on IL-6R and/or the IL-6/IL-6R complex and/or (ii) that can compete with gp130 for binding to the IL-6/IL-6R complex (or visa versa).

344. Method according to aspect 322, wherein in step b), the set, collection or library of nucleic acid sequences is screened nucleic acid sequences that encode a first amino acid sequence that (i) can bind to and/or has affinity for the binding site for the reference IgG and reference Fab on IL-6R and/or (ii) competes with the reference IgG and reference Fab for binding to IL-6R and wherein in step d), the set, collection or library of nucleic acid sequences is screened for nucleic acid sequences that encode a second amino acid sequence that (i) can bind to and/or has affinity for the M182 binding site on IL-6R and/or (ii) that can compete with M182 for binding to IL-6R (or visa versa).

345. Method according to aspect 322, wherein in step b), the set, collection or library of nucleic acid sequences is screened nucleic acid sequences that encode a first amino acid sequence that (i) can bind to and/or has affinity for the binding site for the reference IgG and reference Fab on IL-6R and/or (ii) competes with the reference IgG and reference Fab for binding to IL-6R and wherein in step d), the set, collection or library of nucleic acid sequences is screened for nucleic acid sequences that encode a second amino acid sequence that (i) can bind to and/or has affinity for the BN-12 binding site on IL-6R and/or (ii) that can compete with BN-12 for binding to IL-6R (or visa versa).

346. Method according to aspect 322, wherein in step b), the set, collection or library of nucleic acid sequences is screened nucleic acid sequences that encode a first amino acid sequence that (i) can bind to and/or has affinity for the BN-12 binding site on IL-6R and/or (ii) competes with BN-12 for binding to IL-6R and wherein in step d), the set, collection or library of nucleic acid sequences is screened for nucleic acid sequences that encode a second amino acid sequence that (i) can bind to and/or has affinity for the gp 130 binding site on IL-6R and/or the IL-6/IL-6R complex and/or (ii) that can compete with gp130 for binding to the IL-6/IL-6R complex (or visa versa).

347. Method according to aspect 322, wherein in step b), the set, collection or library of nucleic acid sequences is screened nucleic acid sequences that encode a first amino acid sequence that (i) can bind to and/or has affinity for the BN-12 binding site on IL-6R and/or (ii) competes with BN-12 for binding to IL-6R and wherein in step d), the set, collection or library of nucleic acid sequences is screened for nucleic acid sequences that encode a second amino acid sequence that (i) can bind to and/or has affinity for the M182 binding site on IL-6R and/or (ii) that can compete with M182 for binding to IL-6R (or visa versa).
348. Method according to any of aspects 322 to 347, wherein the screening in steps b) and/or d) is performed in the presence of IL-6, Tocilizumab (MRA), gp130, M182 and/or BN-12.
349. Method for preparing and/or generating a multiparatopic (such as e.g. biparatopic, triparatopic, etc.) polypeptide or constructs according to any of aspects 1 to 132, said method comprising at least the steps of linking two or more monovalent amino acid sequences according to any of aspects 133 to 186, monovalent Nanobodies according to any of aspects 187 to 197 and/or monovalent constructs according to any of aspects 238 to 241 and for example one or more linkers.
350. Method according to aspect 349, comprising the steps of:
  a) linking two or more nucleic acid sequences according to aspect 266, encoding a monovalent amino acid sequence according to any of aspects 133 to 186, a monovalent Nanobody according to any of aspects 187 to 197 and/or a monovalent construct according to any of aspects 238 to 241 (and also for example nucleic acids encoding one or more linkers and further one or more further elements of genetic constructs known per se) to obtain a genetic construct according to aspect 267;
  b) expressing, in a suitable host cell or host organism or in another suitable expression system, the genetic construct obtained in a)
  optionally followed by:
  c) isolating and/or purifying the multiparatopic (such as e.g. biparatopic, triparatopic, etc.) polypeptide or construct according to any of aspects 1 to 132 thus obtained.
351. Host or host cell that expresses, or that under suitable circumstances is capable of expressing, an amino acid sequence according to any of aspects 133 to 186, a Nanobody according to any of aspects 187 to 197, a polypeptide according to any of aspects 1 to 132 and 198 to 216, a compound or construct according to any of aspects 217 to 237 that is such that it can be obtained by expression of a nucleic acid or nucleotide sequence encoding the same, or a monovalent construct according to any of aspects 238 to 241; and/or that comprises a nucleic acid or nucleotide sequence according to aspect 266 or a genetic construct according to aspect 267.
352. Composition comprising at least one amino acid sequence according to any of aspects 133 to 186, Nanobody according to any of aspects 187 to 197, polypeptide according to any of aspects 1 to 132 and 198 to 216, compound or construct according to any of aspects 217 to 237, monovalent construct according to any of aspects 238 to 241, or nucleic acid or nucleotide sequence according to aspects 266 or 267.
353. Composition according to aspect 352, which is a pharmaceutical composition.
354. Composition according to aspect 353, which is a pharmaceutical composition, that further comprises at least one pharmaceutically acceptable carrier, diluent or excipient and/or adjuvant, and that optionally comprises one or more further pharmaceutically active polypeptides and/or compounds.
355. Method for producing an amino acid sequence according to any of aspects 133 to 186, a Nanobody according to any of aspects 187 to 197, a polypeptide according to any of aspects 1 to 132 and 198 to 216, a compound or construct according to any of aspects 217 to 237 that is such that it can be obtained by expression of a nucleic acid or nucleotide sequence encoding the same, or a monovalent construct according to any of aspects 238 to 241, said method at least comprising the steps of:
  a) expressing, in a suitable host cell or host organism or in another suitable expression system, a nucleic acid or nucleotide sequence according to aspect 266, or a genetic construct according to aspect 267;
  optionally followed by:
  b) isolating and/or purifying the amino acid sequence according to any of aspects 133 to 186, the Nanobody according to any of aspects 187 to 197, the polypeptide according to any of aspects 1 to 132 and 198 to 216, the compound or construct according to any of aspects 217 to 237, or the monovalent construct according to any of aspects 238 to 241 thus obtained.
356. Method for producing an amino acid sequence according to any of aspects 133 to 186, a Nanobody according to any of aspects 187 to 197, a polypeptide according to any of aspects 1 to 132 and 198 to 216, a compound or construct according to any of aspects 217 to 237 that is such that it can be obtained by expression of a nucleic acid or nucleotide sequence encoding the same, or a monovalent construct according to any of aspects 238 to 241, said method at least comprising the steps of:
  a) cultivating and/or maintaining a host or host cell according to aspect 351 under conditions that are such that said host or host cell expresses and/or produces at least one amino acid sequence according to any of aspects 133 to 186, Nanobody according to any of aspects 187 to 197, a polypeptide according to any of aspects 1 to 132 and 198 to 216, a compound or construct according to any of aspects 217 to 237, or monovalent construct according to any of aspects 238 to 241;
  optionally followed by:
  b) isolating and/or purifying the amino acid sequence according to any of aspects 133 to 186, Nanobody according to any of aspects 187 to 197, polypeptide according to any of aspects 1 to 132 and 198 to 216, compound or construct according to any of aspects 217 to 237, or monovalent construct according to any of aspects 238 to 241 thus obtained.
357. Method for screening amino acid sequences directed against IL-6R that comprises at least the steps of:
  a) providing a set, collection or library of nucleic acid sequences encoding amino acid sequences;
  b) screening said set, collection or library of nucleic acid sequences for nucleic acid sequences that encode an amino acid sequence that can bind to and/or has affinity for IL-6R and that is cross-blocked or is cross blocking a Nanobody of the invention, e.g. SEQ ID NO: 132-216 (Table-A-3), or a polypeptide or construct of the invention, e.g. SEQ ID NO: 812-947 (see Table A-4, A-5 and A-6); and
  c) isolating said nucleic acid sequence, followed by expressing said amino acid sequence.
358. Method for the prevention and/or treatment of at least one IL-6R related disease or disorder, said method comprising administering, to a subject in need thereof, a pharmaceutically active amount of at least one amino acid sequence according to any of aspects 133 to 186, Nanobody according to any of aspects 187 to 197, polypeptide according to any of aspects 1 to 132 and 198 to 216, compound or construct according to any of aspects 217 to 237, monovalent construct according to any of aspects 238 to 241; or composition according to aspect 353 or 354.

359. Method for the prevention and/or treatment of at least one disease or disorder that is associated with IL-6R, with its biological or pharmacological activity, and/or with the biological pathways or signalling in which IL-6R is involved, said method comprising administering, to a subject in need thereof, a pharmaceutically active amount of at least one amino acid sequence according to any of aspects 133 to 186, Nanobody according to any of aspects 187 to 197, polypeptide according to any of aspects 1 to 132 and 198 to 216, compound or construct according to any of aspects 217 to 237, monovalent construct according to any of aspects L238 to 241; or composition according to aspect 353 or 354.

360. Method for the prevention and/or treatment of at least one disease or disorder that can be prevented and/or treated by administering, to a subject in need thereof, at least one amino acid sequence according to any of aspects 133 to 186, Nanobody according to any of aspects 187 to 197, polypeptide according to any of aspects 1 to 132 and 198 to 216, compound or construct according to any of aspects 217 to 237, monovalent construct according to any of aspects 238 to 241; or composition according to aspect 2532 or 254, said method comprising administering, to a subject in need thereof, a pharmaceutically active amount of at least one at least one amino acid sequence according to any of aspects 133 to 186, Nanobody according to any of aspects 187 to 197, polypeptide according to any of aspects 1 to 132 and 198 to 216, compound or construct according to any of aspects 217 to 237, monovalent construct according to any of aspects 238 to 241; or composition according to aspect 253 or 254.

361. Method for immunotherapy, said method comprising administering, to a subject in need thereof, a pharmaceutically active amount of at least one amino acid sequence according to any of aspects 133 to 186, Nanobody according to any of aspects 187 to 197, polypeptide according to any of aspects 1 to 132 and 198 to 216, compound or construct according to any of aspects 217 to 237, monovalent construct according to any of aspects 238 to 241; or composition according to aspect 253 or 254.

362. Use of an amino acid sequence according to any of aspects 133 to 186, a Nanobody according to any of aspects 187 to 197, a polypeptide according to any of aspects 1 to 133 and 198 to 216, a compound or construct according to any of aspects 217 to 237, or a monovalent construct according to any of aspects 238 to 241 in the preparation of a pharmaceutical composition for prevention and/or treatment of at least one IL-6R related disease or disorder; and/or for use in one or more of the methods according to aspects 358 to 361.

363. Amino acid sequence according to any of 133 to 186, Nanobody according to any of aspects 187 to 197, polypeptide according to any of aspects 1 to 132 and 198 to 216, compound or construct according to any of aspects 217 to 237, monovalent construct according to any of aspects 238 to 241; or composition according to aspect 253 or 254 for the prevention and/or treatment of at least one IL-6R related disease or disorder.

364. Part or fragment of an amino acid sequence according to any of aspects 133 to 186, or of a Nanobody according to any of aspects 187 to 197.

365. Part or fragment according to aspect 3641, that can specifically bind to IL-6R.

366. Part of fragment according to any of aspects 364 or 365, that can specifically bind to IL-6R with a dissociation constant ($K_D$) of $10^{-5}$ to $10^{-12}$ moles/litre or less, and preferably $10^{-7}$ to $10^{-12}$ moles/litre or less and more preferably $10^{-8}$ to $10^{-12}$ moles/litre.

367. Part or fragment according to any of aspects 364 to 366, that can specifically bind to IL-6R with a rate of association ($k_{on}$-rate) of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$.

368. Part or fragment according to any of aspects 364 to 367, that can specifically bind to IL-6R with a rate of dissociation ($k_{off}$ rate) between 1 $s^{-1}$ and $10^{-6}$ $s^{-1}$ preferably between $10^{-2}$ $s^4$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

369. Compound or construct, that comprises or essentially consists of one or more parts or fragments according to any of aspects 364 to 368, and optionally further comprises one or more other groups, residues, moieties or binding units, optionally linked via one or more linkers, 370. Compound or construct according to aspect 369, in which said one or more other groups, residues, moieties or binding units are amino acid sequences.

371. Compound or construct according to aspect 369 or 370, in which said one or more linkers, if present, are one or more amino acid sequences.

372. Nucleic acid or nucleotide sequence, that encodes a part or fragment according to any of aspects 364 to 368 or a compound or construct according to any of aspects 369 to 371.

373. Composition, comprising at least one part or fragment according to any of aspects 364 to 368, compound or construct according to any of aspects 369 to 371, or nucleic acid or nucleotide sequence according to aspect 372.

374. Derivative of a polypeptide according to any of aspects 1 to 132, an amino acid sequence according to any of aspects 133 to 186, or of a Nanobody according to any of aspects 187 to 197.

375. Derivative according to aspect 374, that can specifically bind to IL-6R.

376. Derivative according to any of aspects 374 or 375, that can specifically bind to IL-6R with a dissociation constant ($K_D$) of $10^{-5}$ to $10^{-12}$ moles/litre or less, and preferably $10^{-7}$ to $10^{-12}$ moles/litre or less and more preferably $10^{-8}$ to $10^{-12}$ moles/litre.

377. Derivative according to any of aspects 374 to 376, that can specifically bind to IL-6R with a rate of association ($k_{on}$-rate) of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$.

378. Derivative according to any of aspects 374 to 377, that can specifically bind to IL-6R with a rate of dissociation ($k_{off}$ rate) between 1 $s^{-1}$ and $10^{-6}$ $s^{-1}$ preferably between $10^{-2}$ $s^{-1}$ and $10^{-6}$ $s^{-1}$, more preferably between $10^{-3}$ $s^{-1}$ and $10^6$ $s^{-1}$, such as between $10^{-4}$ $s^{-1}$ and $10^{-6}$ $s^{-1}$.

379. Derivative of a polypeptide according to any of aspects 198 to 216 or compound or construct according to any of aspects 217 to 237.

380. Derivative according to aspect 379, that can specifically bind to IL-6R.

381. Derivative according to any of aspects 379 or 380, that can specifically bind to IL-6R with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter.

382. Derivative according to any of aspects 379 to 381, that can specifically bind to IL-6R with a rate of association ($k_{on}$-rate) of between $10^2$ $M^{-1}s^{-1}$ to about $10^7$ $M^{-1}s^{-1}$, preferably between $10^3$ $M^{-1}s^{-1}$ and $10^7 M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$.

383. Derivative according to any of aspects 379 to 382, that can specifically bind to IL-6R with a rate of dissociation ($k_{off}$-rate) between 1 $s^{-1}$ and $10^{-6}$ $s^{-1}$ preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

384. Derivative according to any of aspects 374 to 383, that has a serum half-life that is at least 1.5 times, preferably at least 2 times, such as at least 5 times, for example at least 10 times or more than 20 times, greater than the half-life of the corresponding amino acid sequence according to any of aspects 133 to 186 per se, Nanobody according to any of aspects 187 to 197 per se, polypeptide according to any of aspects 1 to 132 and 198 to 216 per se or compound or construct according to any of aspects 217 to 237 per se.

385. Derivative according to any of aspects 374 to 384, that has a serum half-life that is increased with more than 1 hours, preferably more than 2 hours, more preferably more than 6 hours, such as more than 12 hours, or even more than 24, 48 or 72 hours, compared to the corresponding amino acid sequence according to any of aspects 133 to 186 per se, Nanobody according to any of aspects 187 to 197 per se, polypeptide according to any of aspects 1 to 132 and 198 to 216 per se or compound or construct according to any of aspects 217 to 237 per se, respectively.

386. Derivative according to any of aspects 374 to 385, that has a serum half-life in human of at least about 12 hours, preferably at least 24 hours, more preferably at least 48 hours, even more preferably at least 72 hours or more; for example, at least 5 days (such as about 5 to 10 days), preferably at least 9 days (such as about 9 to 14 days), more preferably at least about 10 days (such as about 10 to 15 days), or at least about 11 days (such as about 11 to 16 days), more preferably at least about 12 days (such as about 12 to 18 days or more), or more than 14 days (such as about 14 to 19 days).

387. Derivative according to any of aspects 374 to 386, that is a pegylated derivative.

388. Compound or construct, that comprises or essentially consists of one or more derivatives according to any of aspects 374 to 387, and optionally further comprises one or more other groups, residues, moieties or binding units, optionally linked via one or more linkers.

389. Compound or construct according to aspect 388, in which said one or more other groups, residues, moieties or binding units are amino acid sequences.

390. Compound or construct according to aspect 388, in which said one or more linkers, if present, are one or more amino acid sequences.

391. Nucleic acid encoding a compound or construct according to aspect 389 or 390.

392. Composition, comprising at least one derivative to any of aspects 374 to 387, compound or construct according to any of aspects 388 to 390, or nucleic acid or nucleotide sequence according to aspect 391.

EXAMPLES

Example 1: Materials

Human IL-6 was obtained from eBioscience (San Diego, Calif.) as a recombinant protein produced in *E. coli*.

Human bio-IL-6 was obtained from eBioscience (San Diego, Calif.) as human IL6 biotinylated by PE (6 biotins/molecule).

Human soluble IL-6R was obtained from Peprotech (Rocky Hill, N.J.) as a recombinant protein produced in HEK293 cells and from R&D Systems (Minneapolis, Minn.) as a recombinant protein produced in Sf21 cells.

MAb BR-6 is a neutralizing anti-IL-6R monoclonal antibody obtained from Diaclone.

MAb BN-12 is a non-neutralizing anti-IL-6R monoclonal antibody obtained from Diaclone.

MAb M182 is a biotinylated anti-IL-6R monoclonal antibody obtained from BD Biosciences (San Jose, Calif.).

Llama IgG (h&l) antibody HRP (horse radish peroxidase) conjugated is a polyclonal antibody against llama IgG raised in goat obtained from Bethyl Labs (Montgomery, Tex.).

BAF206 is a biotinylated anti-human IL-6 polyclonal antibody from R&D Systems (Minneapolis, Minn.).

BAF227 is a biotinylated anti-IL-6R polyclonal antibody from R&D Systems (Minneapolis, Minn.).

Two representative anti-human IL-6R immunoglobulins described in EP 0 628 639 (a Fab fragment and a full-sized IgG) were generated and used as reference compounds. The Fab fragment and full-sized IgG were constructed based on the L-chain called "$RV_L a$" (see EP 0 628 639 B1, Table 2, version (a)) and the H-chain called "$RV_H f$" (see EP 0 628 639 B1, Table 3, version (f)). These particular L-chain and H-chain were chosen for the purposes of constructing the reference compounds because, according to EP 0 268 639 B1 (see for example paragraph [0074]), a reshaped human antibody comprising said L-chain and said H-chain exhibited an ability to bind to human IL-6R at the same level as PM1, a mouse monoclonal antibody against human IL-6R (see again EP 0 628 639 B1, paragraph [009] and the further references cited therein).

The full-length reference IgG consisted of the amino acid sequences of SEQ ID NO: 126 (heavy chain) and SEQ ID NO: 127 (light chain). The Fab fragment consisted of the amino acid sequences of SEQ ID NO: 128 (heavy chain regions $V_L b$ and $V_H f$ fused to the CH1 region of human IgG1) and SEQ ID NO: 129 (reshaped human PM-1 variable light chain fused to human Ckappa).

Encoding DNA fragments were generated by assembly PCR using partially overlapping oligonucleotides. PCR products were cloned into a single, bi-cistronic vector which enables expression of functional, disulphide-linked Fab fragments in the periplasm of *E. coli*. Full-length IgG was produced in CHO cells transfected with 2 expression vectors containing the genes for the light and heavy chains. The gene encoding the heavy chain was created by fusing $V_H f$ to the constant region of human IgG1. The light chain was as described in EP 0 628 639.

Example 2: Generation of a Cell Lines Expressing Human IL-6R and Cyno IL-6R

The complete codon-optimized DNA sequence of human IL-6R was synthesized by Geneart (Regensburg, Germany) and cloned into pcDNA3.1 Hygro (+) (Invitrogen, Carlsbad, Calif.). The resulting plasmid was transfected into camelid kidney cells and CHO-K1 cells. The transfected cell pool was kept under selection pressure (100 µg/ml Hygromycin for the camelid kidney cells and 400 µg/ml for CHO cells) from day two after transfection. Twenty-eight days later, an IL-6R positive population was sorted with the use of anti-IL-6R monoclonal antibody BR-6 (FACS aria). Single cells were seeded into 96-well cell culture plates. Growing clones were tested for IL-6R expression on a FACS array device with the use of anti-IL-6R monoclonal antibody BR-6. Clones HuIL6R 2F1 (camelid kidney cells) and HuIL6R 4D6 (CHO-K1 cells) were selected for further use.

A codon-optimized DNA sequence encoding the amino acid sequence of the extracellular domain of cyno IL-6R (as described by Imazeki et al, 1998, *International Journal of Immunopharmacology* 20: 345-357) combined with the human-rhesus amino acid sequence for the transmembrane and intracellular region of IL-6R, was assembled using overlapping oligonucleotides.

The resulting plasmid was transfected into CHO-K1 cells. The transfected cell pool was kept under selection pressure (1 mg/ml G418) from day two after transfection. Twenty days later, an IL-6R positive population was sorted with the use of anti-IL6R monoclonal antibody BR-6 (FACS aria). Single cells were seeded into 96-well cell culture plates. Growing clones were tested for IL-6R expression on a FACS array device with the use of anti-IL-6R monoclonal antibody BR-6. Clone CyIL6R 405 (CHO-K1 cells) was selected for further use.

Example 3: Expression and Purification of Hybrid IL-6R

The ectodomain of IL-6R is composed of 3 subdomains. Only subdomains II and III interact with IL-6. To map the domain(s) to which a particular Nanobody binds, we constructed a hybrid IL-6R molecule consisting of the 6×His-tagged ectodomain of human IL-6R, except a majority of domain I, which was replaced by the Rat IL-6R sequence (the rat IL-6R sequence differs drastically from the human IL-6R sequence). The amino acid sequence of hybrid IL-6R is depicted in FIG. 1 (SEQ ID NO: 131).

The complete codon-optimized DNA sequence of hybrid IL-6R was synthesized by Geneart and cloned into an expression plasmid. The resulting plasmid was transfected into HEK.EBNA cells (adapted to animal-component-free Pro293a culture medium; Lanza, Basel, Switzerland) using a standard transfection method. Supernatant was harvested and refreshed each 2-3 days for 14 days. The pool of supernants was applied to a Source 30S column. Hybrid IL-6R eluted between 150 and 500 mM NaCl. This elution fraction was further purified to homogeneity consecutively by Histrap chromatography and superdex200 10/300 GL chromatography.

Example 4: Immunizations

Three llamas (128, 129 and 130) were immunized with clone HuIL6R 2F1 according to the scheme outlined in Table C-1.

Figure 2B:
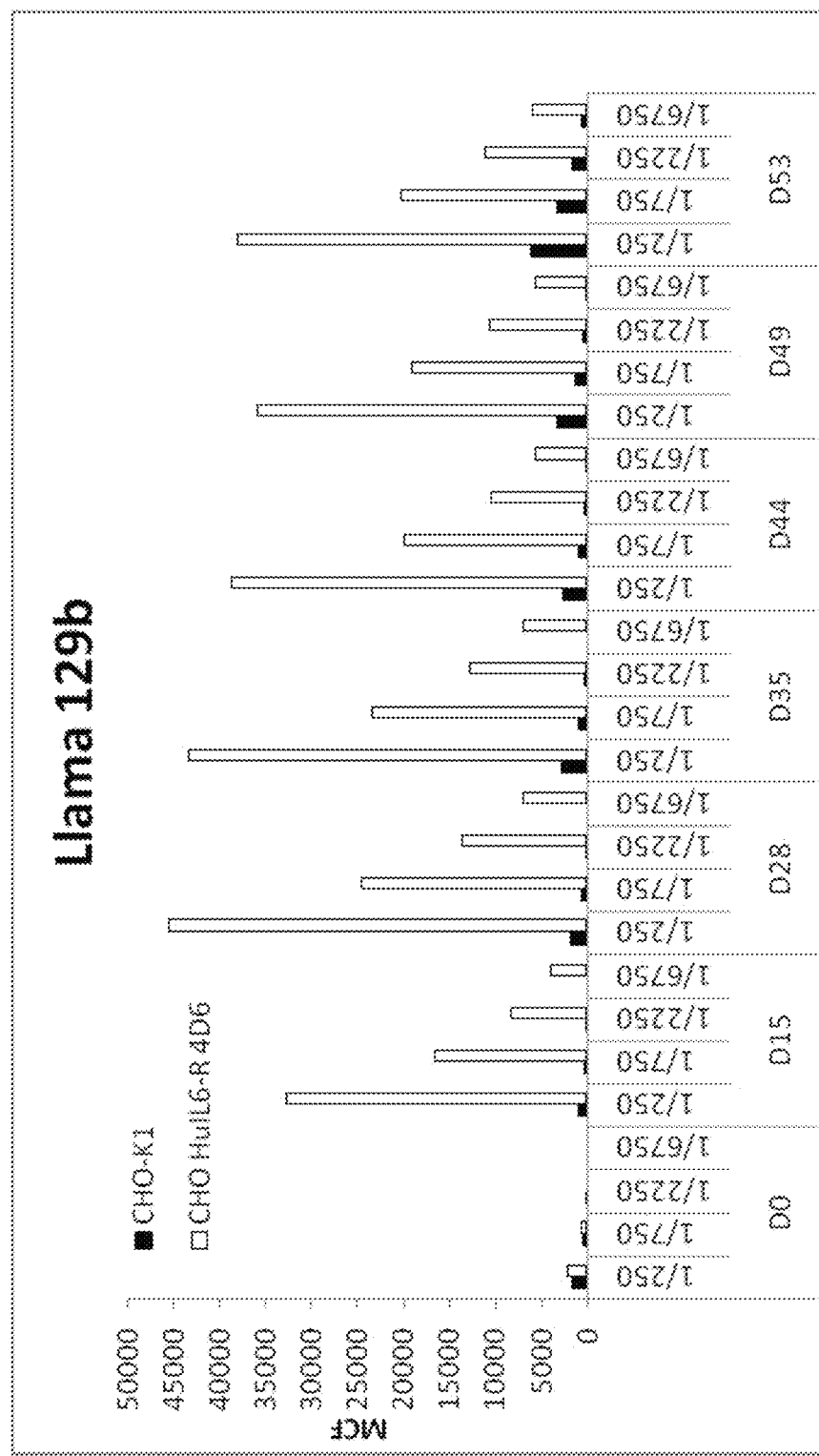
Figure 2C:
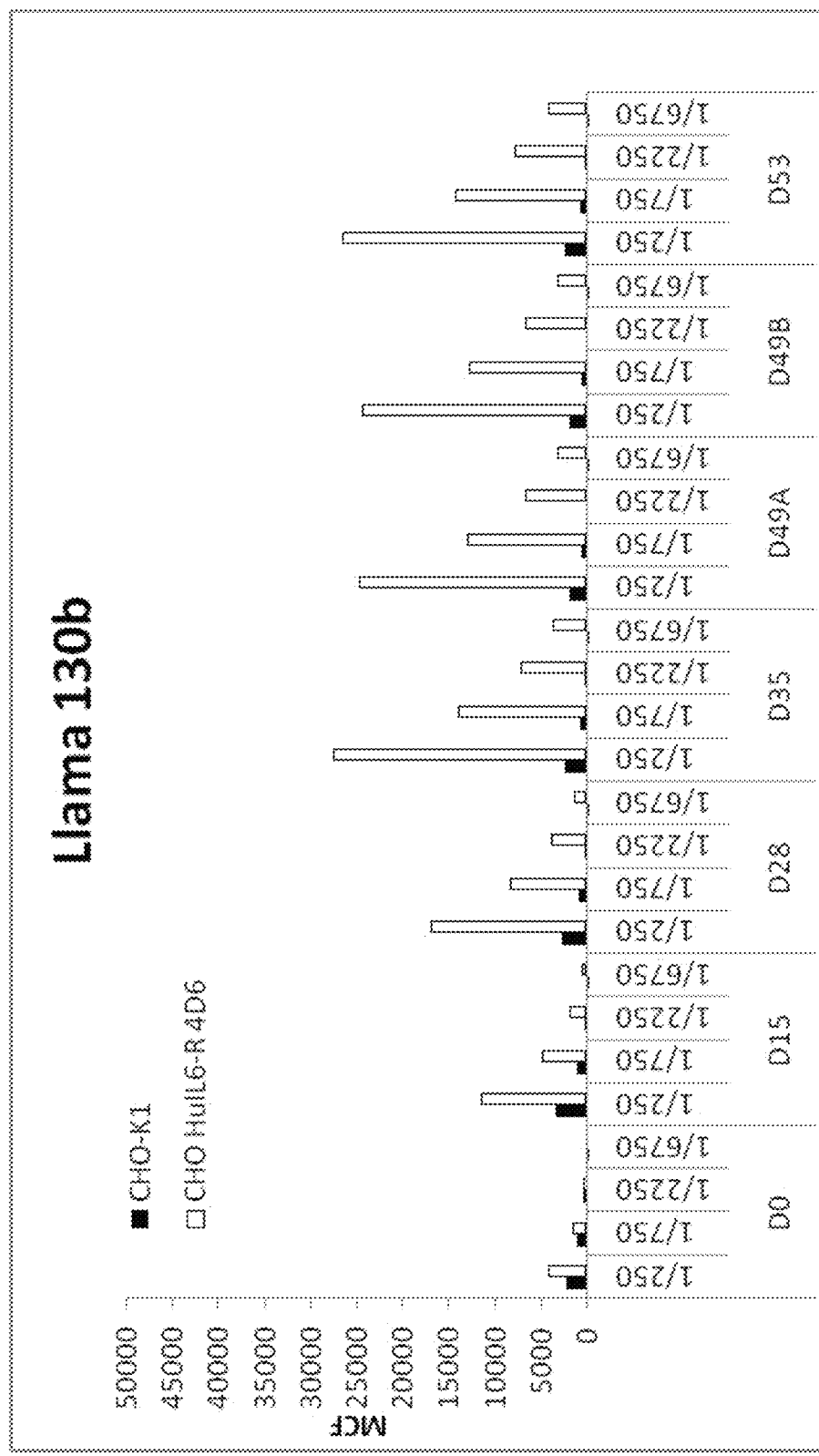

After completion of the protocol, immune responses were analyzed by FACS (FACS array): serial dilutions (starting dilution: 1/250) of serum samples collected at days 0, 14, 28, 35, 44, 49, 53 were incubated with CHO-K1 clone 406. Bound llama IgG was detected by goat anti-Llama IgG (Bethyl A160-100; Montgomery, Tex.). Results are shown in FIG. 2 (*a-c*).

Example 5: Library Construction

RNA extracted from peripheral blood lymphocytes (PBL) and lymph node (LN) obtained from llama 128b, 129b and 130b was used as starting material for RT-PCR to amplify Nanobody encoding gene fragments. These fragments were cloned into a phagemid vector. Phage was prepared according to standard methods and stored after filter sterilization at 4° C. for further use. The characteristics of the constructed libraries are shown in Table C-2.

Example 6: Selections

Selections were carried out with the above libraries using various conditions as summarized in Table C-3.

Two rounds of selection were performed: two times the same experimental condition or combining two different conditions. Each selection output was analyzed for enrichment factor (# phage present in eluate relative to control) and plated for further analyses. Colonies were picked, grown in 96-well plates and stored in 20% glycerol in −80 C. Copies of the output plates were grown in 96 deep well plates (1 ml volume) and induced by adding IPTG for Nanobody expression. Periplasmic extracts (volume: ~90 µl) were prepared according to standard methods (see for example the prior art and applications filed by Ablynx N.V. cited herein).

Example 7: Screening

Periplasmic extracts were analyzed for their ability to inhibit the IL-6/IL-6R interaction. To this end, two independent Alphascreen assays were set up which are depicted schematically in FIG. 3. In assay 1, the periplasmic extracts were incubated with biotinylated IL-6 (3.3 nM), soluble IL-6 receptor (0.4 nM), streptavidin coated donor beads and MAb BN-12 coated acceptor beads (20 mg/ml). Nanobodies positive in this assay could either inhibit the IL-6/IL-6R interaction or the IL-6R/MAb BN-12 interaction. To discriminate between these 2 possibilities, a second assay was set up (Assay 2). In this assay the periplasmic extract were incubated with bio-IL-6R (0.1 nM), streptavidin coated donor beads and MAb BN-12 coated acceptor beads (10 µg/ml). Nanobodies positive in assay 1 but negative in assay 2 were considered as IL-6/IL-6R inhibitors. Periplasmic extracts were diluted 25-fold in both assays which corresponds roughly to a final concentration of 40 nM.

This resulted in two different subclasses of anti-IL-6R Nanobodies:
  Subclass 1: Nanobodies against 1-L6R that were capable of modulating (e.g. partially or fully reducing or preventing) binding of IL-6 to IL-6R. In the present example, these were obtained in selections where IL-6R was immobilized on MAb BN-12 (although other methods of obtaining such Nanobodies will be clear to the skilled person).
  Subclass 2: Nanobodies against IL-6R that were capable of modulating (e.g. partially or fully reducing or preventing) binding of IL-6R to MAb BN-12. In the present example, these were obtained in alternative selection strategies where IL-6R was not immobilized on MAb BN-12 (although other methods of obtaining such Nanobodies will be clear to the skilled person).

A statistical overview of the screening effort is shown in Table C-4. Nanobodies showing the strongest inhibition were selected for further characterization.

Example 8: Sequence Analysis 509 clones were subjected to sequence analysis (AGOWA, Middlesex, UK). Of these 509 clones 327 clones could inhibit the IL-6/IL-6R interaction and 182 were randomly picked clones. Based on the amino acid sequence homology (especially homology for CDR3) all clones were classified in 36 different families. Members of the same family are believed to have similar behavior in the different assays described in this patent application, though small differences in functional properties are possible. One or several representatives per family were chosen for further characterization. 14 families could inhibit the IL6/IL6R interaction.

Example 9: Characterization of the Nanobodies Obtained (Analyzed as Periplasmic Extract)

Potency ELISA

In this ELISA, plasma was used as a source of native soluble IL-6R. By this assay, we aimed to confirm the alphascreen results and to get a view on the cross-reactivity of the clones towards cynomolgous IL-6R. Human plasma (ELISA 1 and ELISA 3) or cynomolgous plasma (ELISA 2) were pre-incubated with a dilution of the periplasmic extract of the clones together with human IL-6 (50 ng/mL). Subsequently, plasma soluble IL-6R was captured on a B-N12 coated plate and bound IL-6 was detected using anti-IL-6 antibody BAF206 and streptavidin-HRP (ELISA 1 and ELISA 2). The ELISA signal dropped when the Nanobody clone could compete with IL-6 for binding to soluble IL-6R. ELISA 3 was a parallel ELISA in which the detection antibody was replaced by anti-IL-6R antibody BAF227 to exclude false positive competitors, which actually compete with B-N12 (e.g. family 2). Depicted in Table C-5 is the ratio of the OD450 value of the test sample versus the blank OD450 (mock sample). Clones were ordered based on ELISA 1 data.

Biacore

Periplasmic extracts of representative family clones were also analyzed on Biacore. Dissociation curves were used to calculate $k_{off}$ rates. $k_{off}$ rates are depicted in Table C-6.

Example 10: Nanobody Expression and Purification

Selected Nanobodies were expressed in *E. coli* as c-myc, His6-tagged proteins in a culture volume of 50 mL. Expression was induced by addition of 1 mM IPTG and allowed to continue for 4 h at 37° C. After spinning the cell cultures, periplasmic extracts were prepared by freeze-thawing the pellets. These extracts were used as starting material for immobilized metal affinity chromatography (IMAC). Nanobodies were eluted from the column with 150 mM imidazole and subsequently buffer-exchanged to PBS. Sequences of a panel of purified Nanobodies are depicted in Table A-3.

Example 11: Characterization of Monovalent Nanobodies

Binding to Hybrid IL-6R

The panel of purified Nanobodies was tested by standard sandwich ELISA with coated human IL-6R versus hybrid IL-6R (see Example 3). Anti-myc-horseradish peroxidase (AbD Serotec, Oxford, UK) was used as a detection antibody. Results are shown in Table C-7. Only Nanobodies with $k_{off}$ rates that were low enough to give a positive signal towards human IL-6R are depicted.

Potency of Monovalent Wild Type Nanobodies in Cell-Based Assay (TF-1)

Nanobodies were also tested for their ability to inhibit IL-6-dependent proliferation of TF-1 cells (ECACC no. 93022307; J. Cell Physiol. 1989, 140: 323; Exp. Cell Res. 1993, 208: 35) by blocking of IL-6 binding to IL-6R on the cell-surface.

The TF-1 cell (ECACC) line was maintained between 2–9×100,000 cells/mL using RPM 1640 supplemented with 2 mM Glutamine, 1% Sodium pyruvate, 3 ng/mL Human GM-CSF (eBiosciences, San Diego, Calif.) and 10% Foetal Bovine serum (Sigma, St. Louis, Mo.). Cells were subcultured 3 times a week and were maintained at 37% and a 5% $CO_2$ atmosphere. The same batch of GM-CSF (Lot E019991) and of Foetal Bovine Serum (lot no 098K3397) was used.

The cell-based assay was performed similarly as described in de Hon et al. (1994, J. Exp. Med. 180: 2395-2400). Cell suspensions were centrifuged for 10 min at 200 g and the supernatant was removed. Cells were resuspended in RPMI 1640 supplemented with 2 mM Glutamine, 1% Sodium pyruvate and 10% Foetal Bovine serum, were seeded at a density of 12500 cells/well in a 96-well plate and incubated for 72 h with different dilutions of the Nanobodies and a constant amount of 200 pg/mL IL-6. The 96-well plates were incubated in a humid chamber. Every sample was analysed in triplicate. The total volume/well was 200 µL. During the last 6 h of the incubation, cells were pulse-labeled with 0.2 µCi/well of $^3$H-thymidine (GE Healthcare, Uppsala, Sweden) in a total volume of 20

Cells were harvested with a semiautomatic cell harvester (Filtermate harvester, PerkinElmer) and the $^3$H-thymidine incorporation was measured using a Topcount NXT counter (PerkinElmer, Waltham, Mass.). Results are expressed as average counts per minute (cpm) per well, 1050 values are summarised in Table C-8.

Potency of Monovalent Wild Type Nanobodies in Plasma Potency ELISA

A potency ELISA was done with the purified Nanobodies as described in Example 9. Here, different dilutions of each purified Nanobody were incubated with human (ELISA1) and cynomolgous plasma (ELISA2). IC50 values are depicted in Table C-9.

Determination of Kd

From the purified panel of Nanobodies, 3 inhibitory Nanobodies were selected which were cross reactive with IL-6R from cynomolgus monkey and which had the lowest IC50 values in the plasma potency ELISA and cell-based assay (TF-1). Besides, 4 non-inhibitory Nanobodies were selected which were cross reactive with IL-6R from cynomolgus monkey, which could bind to the IL-6R domain II and/or III and which had a low $k_{off}$ rate.

Affinity constants (Kd) of these 7 individual Nanobodies were determined by surface plasmon resonance on a Biacore 3000 instrument. In brief, IL-6R was amine-coupled to a CM5 sensor chip at a density of 800-1000 RU. Remaining reactive groups are inactivated. Nanobody binding was assessed at various concentrations ranging from 0.5 to 50 nM. Each sample was injected for 4 min at a flow rate of 45 µl/min to allow for binding to chip-bound antigen. Next, binding buffer without Nanobody was sent over the chip at the same flow rate to allow for dissociation of bound Nanobody. After 10 min, remaining bound analyte was removed by injecting regeneration solution (Glycine/HCl pH1.5). Binding curves obtained at different concentrations of Nanobody were used to calculate Kd values. In Table C-10, an overview of $k_d/k_{off}$, $k_a$, and $K_d$ values for the selected subset of 14 Nanobodies is shown.

Epitope mapping by FMAT

Eleven inhibitory Nanobodies were tested in competition with labelled Reference IgG for binding to CHO cells expressing hIL-6R or cynoIL-6R. A range of concentrations of the Nanobodies and cold Reference IgG were incubated with Reference IgG-A647 and 5000 CHO cells expressing either human IL-6R (clone 4D6) or cyno IL-6R (clone 405) for 2 hours. Signals were measured in FMAT and the 1050 values determined. IC50 values are shown in Table C-11.

Example 12: Construction and Expression of Biparatopic Anti-IL-6R Nanobodies

Inhibitory Nanobodies and non-inhibitory Nanobodies were combined into biparatopic molecules (Table C-12). A 35GS linker (7xGGGGS) was chosen as a flexible linker between both building blocks. The inhibitory Nanobody was placed at the C-terminus. Sequences of the biparatopic constructs are depicted in Tables A-4, A-5 and A-6.

Example 13: Characterization of Biparatopic Anti-IL-6R Nanobodies

Potency Assay

Figure 4A:
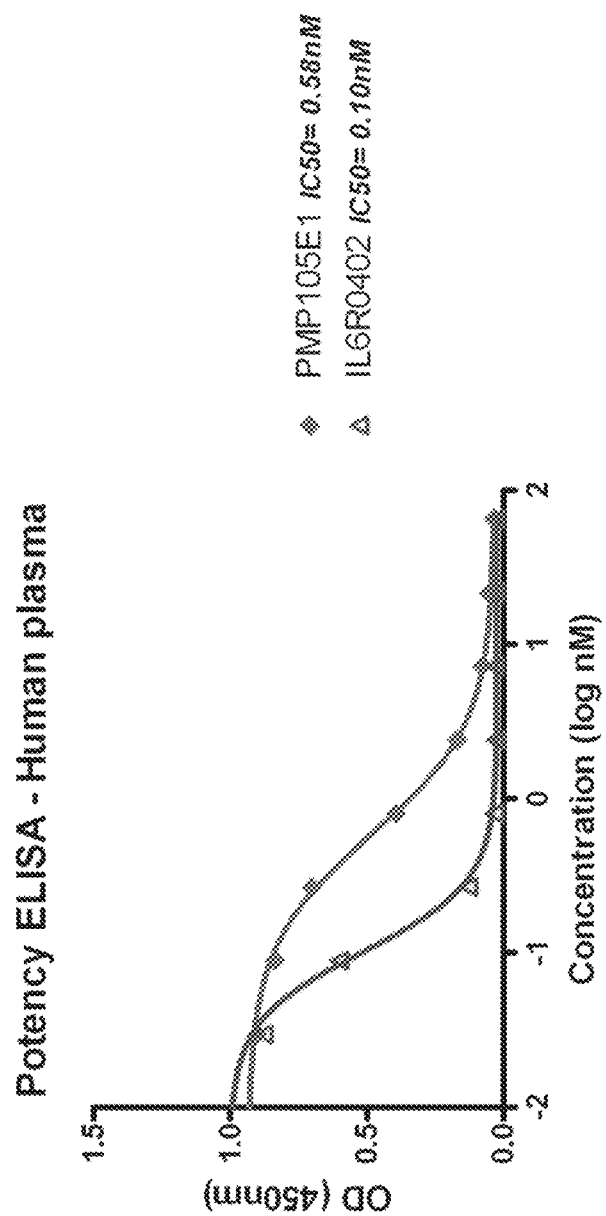
FIG. 4: Potency of the Nanobodies to inhibit the binding of human IL-6 to human soluble IL-6R (FIG. 4a), and cynomolgus monkey soluble IL-6R (FIG. 4b) present in plasma. The anti-IL-6R biparatopic Nanobody IL6R0402 was compared with the monovalent Nanobody.
Figure 4B:
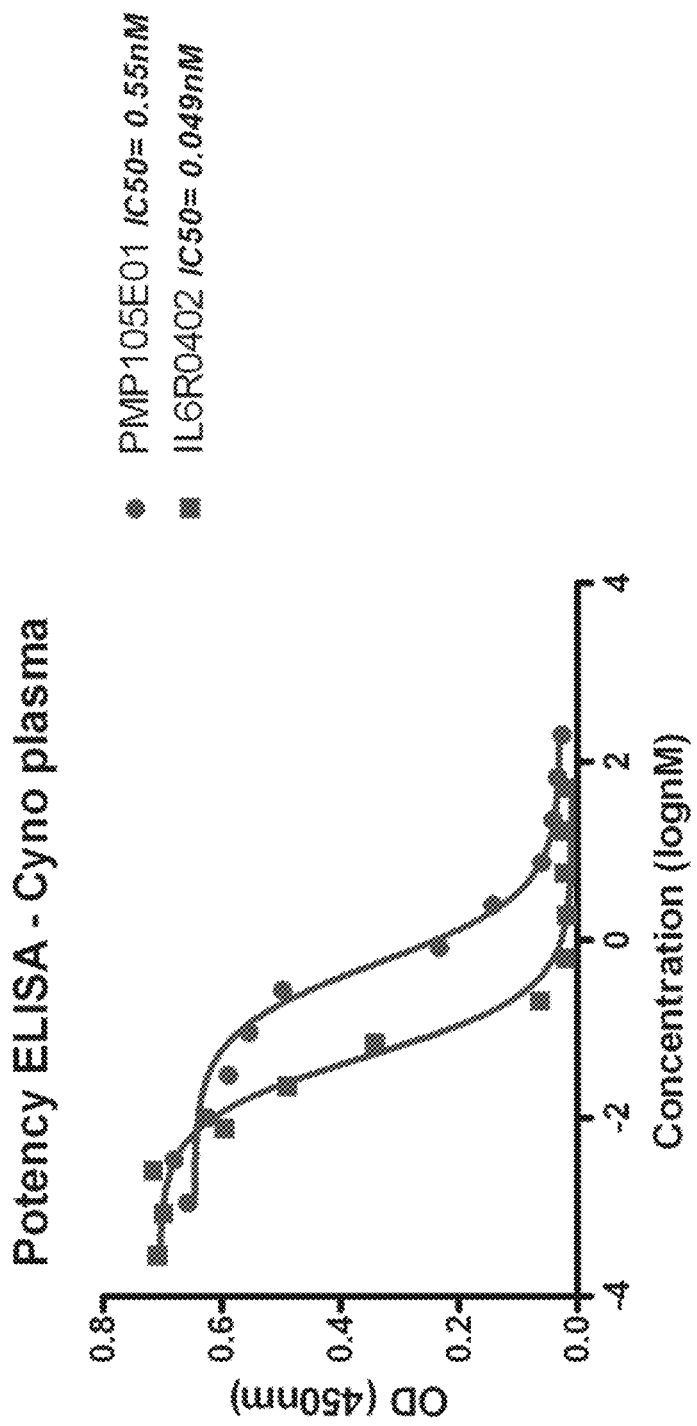

This assay was performed as described in Example 9. The effect of linking a non-inhibiting Nanobody to an inhibiting Nanobody PMP105E1 was assessed by comparing PMP105E1 itself with one biparatopic construct IL6R0402. Titration curves are depicted in FIGS. 4a and b.

Cell-Based Assay (TF-1 Assay)

Figure 5:
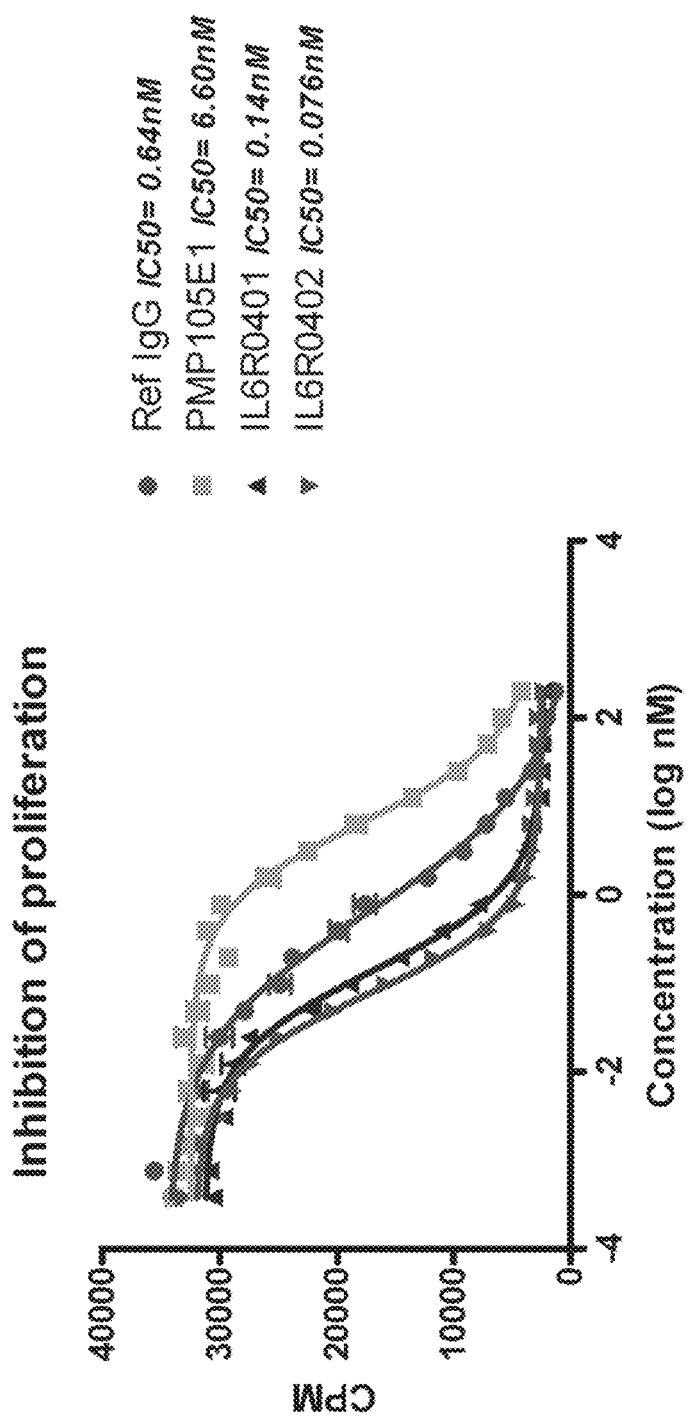
FIG. 5: Antagonistic activity of Nanobodies in cell-based assay (TF-1). The anti-IL-6R biparatopic Nanobodies IL6R0401 and IL6R0402 were compared with the monovalent Nanobody.

This assay was performed as described in Example 11. The effect of linking a non-inhibiting Nanobody to an inhibiting Nanobody PMP105E1 was assessed by comparing PMP105E1 itself with two biparatopic constructs described in Example 12. Titration curves are depicted in FIG. 5.

TABLE A-1

Preferred combinations of CDR sequences

| Nanobody | SEQ ID | FR1 | SEQ ID | CDR 1 | SEQ ID | FR2 | SEQ ID | CDR 2 |
|---|---|---|---|---|---|---|---|---|
| IL6RPMP100A10 | 132 | EVQLVESGGGLVQAG GSLRLSCAASGRGFS | 218 | PYTMG | 302 | WFRQAPG KERVFVA | 387 | GISWSTGIA HYTDSVKG |
| IL6RPMP100A6 | 133 | EVQLVESGGGLVQAG DSLRLSCLASGRSFK | 219 | DDAMG | 303 | WFRQAPG KEREFVS | 388 | GIDWRGNIV DAESVKG |
| IL6RPMP100D11 | 134 | EVQLVESGGGLVQAG DSLRLSCLASGRSFK | 220 | DDAMG | 304 | WFRQAPG KEREFVS | 389 | GIDWRGNIV DAESVKG |
| IL6RPMP100G11 | 135 | EVQLVESGGGLVQAG GSLRLSCAASGRGFS | 221 | PYTMG | 305 | WFRQAPG KERVFVA | 390 | GISWSTGIA HYTDSVKG |
| IL6RPMP101A1 | 136 | EVQLVESGGGTVQAG GSLKLSCAASGRTFT | 222 | NYAMG | 306 | WFRQAPG KEREFVA | 391 | AIAYATHFA DSVKG |
| IL6RPMP101A3 | 137 | EVQLVESGGGLVQAG GPLRLSCTASGRTFT | 223 | DYDMG | 307 | WFRQAPG KEREVVA | 392 | IIDTNGDNT LTVGSVKG |
| IL6RPMP101A4 | 138 | EVQLVESGGGTVQAG GSLKLSCAASGRTFT | 224 | NYAMG | 308 | WFRQAPG KEREFVA | 393 | AIAYATHFA DSVKG |
| IL6RPMP101A5 | 139 | EVQLVESGGGLVQAG GSLRLSCTASGRTFS | 225 | DYDMG | 309 | WFRQAPG KERECVA | 394 | IIDTNGDNT LIVGSVKG |
| IL6RPMP101B12 | 140 | EVQLVESGGGLVQPG GSLRLSCAASGVTLD | 226 | YYAIG | 310 | WFRQAPG KEREGVS | 395 | SISSNDGST FYADSVKG |
| IL6RPMP101B2 | 141 | EVQLVESGGGLVQAG GSLRLSCTASGRTFT | 227 | DYDMG | 311 | WFRQAPG KEREVVA | 396 | IIDTNGDNT LTVGSVKG |
| IL6RPMP101B3 | 142 | EVQLVESGGGLVQAG GSLRLSCAASGSIFR | 228 | INAMG | 312 | WYRQAPG KQRELVA | 397 | AAISGGSTN YADFVKG |
| IL6RPMP101B6 | 143 | EVQLVESGGGLVQAG GSLRLSCAASGSDFS | 229 | IKAMG | 313 | WYRQAPG KQRELVA | 398 | RITSGGSTV YADSVKG |
| IL6RPMP101C2 | 144 | EVQLVESGGGLVQAG GSLRLSCTASGRTFS | 230 | DYDMG | 314 | WFRQAPG KERECVA | 399 | IIDTNGDNT LIVGSVKG |
| IL6RPMP101C3 | 145 | EVQLVESGGGLVRAG GSLRLSCAASGFAFD | 231 | YYAIG | 315 | WFRQAPG KEREGVS | 400 | SISSSNGNT YYADSVRG |
| IL6RPMP101D1 | 146 | EVQLVESGGGLVQAG GSLRLSCTASGRTFS | 232 | DYDMG | 316 | WFRQAPG KERECVA | 401 | IIDTNGDNT LIVGSVKG |
| IL6RPMP101D2 | 147 | EVQMVESGGGLVQAG GSLRLSCAASGFAFD | 233 | DYAIG | 317 | WFRQAPG KEREGVS | 402 | SISSSNGNT YYADSVRG |
| IL6RPMP101D6 | 148 | EVQLVESGGGLVQAG GSLRLSCTASGRTFS | 234 | DYDMG | 318 | WFRQAPG KERECVA | 403 | IIDTNGDNT LIVGSVKG |
| IL6RPMP101E1 | 149 | EVQLVESGGGLVQAG GSLRLSCAASGFAFD | 235 | DYAIG | 319 | WFRQAPG KEREGVS | 404 | SISSSNGNT YYADSVRG |

TABLE A-1-continued

Preferred combinations of CDR sequences

| | | | | |
|---|---|---|---|---|
| IL6RPMP101F1 | 150 EVQLVESGGGLVQAG GSLRLSCAASGFAFD | 236 DYAIG | 320 WFRQAPG KEREGVS | 405 SISSSNGNT YYADSVRG |
| IL6RPMP101F2 | 151 EVQLVESGGGLVQAG GSLRLSCAASGFAFD | 237 DYAIG | 321 WFRQAPG KEREGVS | 406 SISSSNGNT YYADSVRG |
| IL6RPMP101F3 | 152 EVQLVESGGGLVQAG GSLRLSCAASGFAFD | 238 DYAIG | 322 WFRQAPG KEREGVS | 407 SISSSNGNT YYADSVRG |
| IL6RPMP101F6 | 153 EVQLVESGGGLVQAG GSLRLSCAASGSIFS | 239 IKAMG | 323 WYRQAPG KQRELVA | 408 RITSGGSTY YADSVKG |
| IL6RPMP101G1 | 154 EVQLVESGGGLVQPG GSLRLSCAASGGTLD | 240 YYAIG | 324 WFRQAPG KEREGVS | 409 CISSSDGST YYASSVKG |
| IL6RPMP101G11 | 155 EVQLVESGGGLVQPG GSLRLSCAASASGFT | 241 LDYYA IG | 325 WFRQAPG KEREGVS | 410 CISSTDGST YYADSVKG |
| IL6RPMP101G2 | 156 EVQLVESGGGLVQAG GSLRLSCAASGSIFR | 242 INAMG | 326 WYRQAPG KQRELVA | 411 AAISGGSTN YADFVKG |
| IL6RPMP101G3 | 157 EVQLVESGGGLVQAG GSLRLSCTASGRTFS | 243 DYDMG | 327 WFRQAPG KERECVA | 412 IIDTNGDNT LIVGSVKG |
| IL6RPMP101G4 | 158 EVQLVESGGGLVQAG GSLRLSCAASGFAFD | 244 DYAIG | 328 WFRQAPG KEREGVS | 413 SISSSNGNT YYADSVRG |
| IL6RPMP101H3 | 159 EVQLVESGGGLVQAG GSLRLSCAASGFAFD | 245 DYAIG | 329 WFRQAPG KEREGVS | 414 SISSSNGNT YYADSVRG |
| IL6RPMP101H6 | 160 EVQLVESGGGLVQAG GSLRLSCTASGRTFT | 246 DYDMG | 330 WFRQAPG KEREVVA | 415 IIDTNGDNT LTVGSVKG |
| IL6RPMP102G3 | 161 EVQLVESGGGLVQAG GSLRLSCAASGSIDR | 247 INAMG | 331 WYRQAPG KQRDFLA | 416 VITDGDKTL YADSVKG |
| IL6RPMP103A2 | 162 EVQLVESGGGLVQPG GSLRLSCAASGSIFS | 248 INTMG | 332 WYRQVPG KQRELVA | 417 TVRSGSITN YADSVQD |
| IL6RPMP103A4 | 163 EVQLVESGGGLVQPG GSLRLSCAASGSIFS | 249 INTMG | 333 WYRQVPG KQRELVA | 418 TVRSGSITN YADSVQD |
| IL6RPMP103A5 | 164 EVQLVESGGGLVQAG DSLRLSCVASGLPFS | 250 TLHMG | 334 WFRQAPG KEHESVS | 419 AISSDGGSE YYAGSVKG |
| IL6RPMP103B2 | 165 EVQLVESGGGLVQPG GSLRLSCAASGSTFS | 251 INMMA | 335 WYCQAPG KQRELVA | 420 SISSGGGIN YADSVKG |
| IL6RPMP103C3 | 166 EVQLVESGGGLVQPG GSMRLSCAATGAIFS | 252 ISTMG | 336 WYRQAPG AQREFVA | 421 GVGLDGTPN YADSVKG |
| IL6RPMP103C4 | 167 EVQLVESGGGLVEAG GSLRLSCAAAGRTLS | 252 SYSMA | 337 WFRQAPG KEREFVA | 422 IIRGNPSRT YHSDVKG |
| IL6RPMP103C7 | 168 EVQLVESGGGLVQAG GSLSLSCATSGRTIS | 253 DDTMA | 338 WFRQAPG KEREFVA | 423 TITFSGART HYSDSVRD |
| IL6RPMP103D7 | 169 EVQLVESGGGLVEAG GSLRLSCAAAGRTLS | 254 SYSMA | 339 WFRQAPG KEREFVA | 424 IIRGNPSRT YHSDVKG |
| IL6RPMP103F2 | 170 EVQLVESGGGLVQAG GSLRLSCVASGHTSD | 255 TYIMA | 340 WFRQAPG KEREFVA | 425 SILWDGSIT YYADSVKD |
| IL6RPMP103H9 | 171 EVQLVESGGGLVQPG GSLRLSCAASKSIFD | 256 INAMY | 341 WHRQAPG KQRESVA | 426 SITSGGMRN YADSVKD |
| IL6RPMP104A8 | 172 EVQLVESGGGLVQAG GSLRLSCTASGRTFS | 257 DYDMG | 342 WFRQAPG KEREFVA | 427 VIDTNGGHT LTVGSVKG |
| IL6RPMP104B8 | 173 EVQLVESGGGLVQAG GSLRLSCAASGFAFD | 258 DYAIG | 343 WFRQAPG KEREGVS | 428 SISSSNGNT YYADSVRG |
| IL6RPMP104B9 | 174 EVQLVESGGGLVQAG GSLRLSCTASGRTFS | 259 DYDMG | 344 WFRQAPG KERECVA | 429 IIDTNGDNT LIVGSVKG |
| IL6RPMP104E4 | 175 EVQLVESGGGTVQAG GSLKLSCAASGRTFT | 260 NYAMG | 345 WFRQAPG KEREFVA | 430 AIAYATHFA DSVKG |

TABLE A-1-continued

Preferred combinations of CDR sequences

| | | | | |
|---|---|---|---|---|
| IL6RPMP104E7 | 176 EVQLVESGGGLVQAG GSLRLSCAAGGSIFS | 261 INAMG | 346 WYRQAPG KQRELVA | 431 SITSGGTT YADSVKG |
| IL6RPMP105B8 | 177 EVQLVESGGGLVRAG GSLRLSCAASGFAFD | 262 DYAIG | 347 WFRQAPG KEREGVS | 432 SISSSNGNT YYADSVRG |
| IL6RPMP105C2 | 178 EVQLVESGGGLVQAG GSLRLSCAASGSIFR | 263 INAMG | 348 WYRQAPG EQRELVA | 433 AAISGGSTN YADFVKG |
| IL6RPMP105D3 | 179 EVQLEESGGGLVQAG GSLRLSCAASGSIFR | 264 INAMG | 349 WYRQAPG KQRELVA | 434 AAISGGSTN YADFVKG |
| IL6RPMP105E1 | 180 EVQLVESGGGLVQAG GSLRLSCAASGSIFS | 265 IKAMG | 350 WYRQAPG KQRELVA | 435 RITSGGSTY YADSVKG |
| IL6RPMP105E11 | 181 EVQLVESGGGLVQAG GSLRLSCAASGFAFD | 266 DYAIG | 351 WFRQAPG KEREGVS | 436 SISSSNGNT YYADSVRG |
| IL6RPMP105H10 | 182 EVQMVESGGGLVQAG GSLRLSCAASGFAFD | 267 DYAIG | 352 WFRQAPG KEREGVS | 437 SISSSNGNT YYADSVRG |
| IL6RPMP106B2 | 183 EVQLVESGGGLVQAG GSLRLSCAASGSIFR | 268 INAMG | 353 WYRQAPG KQRELVA | 438 AAISGGSTN YADFVKG |
| IL6RPMP106D6 | 184 EVQLVESGGGLVQAG GSLRLSCAASGFTFD | 269 DYAIG | 354 WFRQAPG KEREGVS | 439 CMISSDGST YYADSVKG |
| IL6RPMP106F4 | 185 EVQLVESGGGLVQAG GSLRLSCAASGSIFR | 270 INAMG | 355 WYRQAPG KQRELVA | 440 AAISGGSTN YADFVKG |
| IL6RPMP106F7 | 186 EVQLVESEGGLVQAG GSLRLSCAASGSIFR | 271 INAMG | 356 WYRQAPG KQRELVA | 441 AAISGGSTN YADFVKG |
| IL6RPMP107A1 | 187 EVQLVESGGGLVQAG GSLNLSCNASGDIGS | 272 INAMG | 357 WYRQAPG QQREWVA | 442 VITDTDSTI YPDSVKG |
| IL6RPMP107A9 | 188 EVQLVESGGGLVQAG GSLRLSCAASGGIFS | 273 DMFMG | 358 WFRQAPG KSRESVA | 443 RISPSGNTF YQDSVRG |
| IL6RPMP107B4 | 189 EVQLVESGGGLVQAG GSLRLSCVASGLRLN | 274 MHRMG | 359 WFRQAPG KEREFVA | 444 RIFTDDGDS YYADSVQG |
| IL6RPMP107C3 | 190 EVQLVESGGGLVQAG GSLNLSCNASGDIGS | 275 INAMG | 360 WHRQAPG QQREWVA | 445 VITDTDSTI YPDSVKG |
| IL6RPMP107E4 | 191 EVQLVESGGGLVQAG GSLRLSCAASGSIDR | 276 INAMG | 361 WYRQAPG KQRDFLA | 446 VITDGDKTL YADSVKG |
| IL6RPMP107G10 | 192 EVQLVESGGGLVQAG GSLRLSCAASGSIEN | 277 INAMG | 362 WYRQAPG KQRDFLA | 447 IITDGSKTL YADSVKG |
| IL6RPMP107H2 | 193 KVQLVESGGGLVQPG GSLRLSCAASGFTFS | 278 SYAMS | 363 WVRRAPG KGLEWVS | 448 AINSDGTGS SYAPFVTG |
| IL6RPMP107H5 | 194 EVPLVESGGGLVQAG GSLNLSCNASGDIGS | 279 INAMG | 364 WYRQAPG QQREWVA | 449 VITDTDSTI YPDSVKG |
| IL6RPMP108C10 | 195 EVQLVESGGGLVQAG GSLRLSCTASGRTFS | 280 DYDMG | 365 WFRQAPG KERECVA | 450 VIDTNGDNT LTVGSVKG |
| IL6RPMP108C9 | 196 EVQLVESGGGLVQAG GSLRLSCAASGRTYA | 281 MA | 366 WFRQAPG KEREFVA | 451 AISIVTDYA DSVKG |
| IL6RPMP108D1 | 197 EVQLVESGGGLVQAG GSLRLSCTASGRTFS | 282 DYDMG | 367 WFRQAPG KERECVA | 452 VIDTNGDNT LTVGSVKG |
| IL6RPMP108D10 | 198 EVQLVESGGGSVQAG GSLRLSCTASGRTFS | 283 DYDMG | 368 WFRQAPG KERECVA | 453 VIDTNGDNT LTVGSVKG |
| IL6RPMP108D2 | 199 EVQLVESGGGLVQAG GSLRLSCAASGFTFD | 284 DYDIG | 369 WFRQAPG KEREGVS | 454 GISSSDGNT YYADSVKG |
| IL6RPMP108E1 | 200 EVQLVESGGGLVQAG GSLRLSCAASGFTFD | 285 DYDIG | 370 WFRQAPG KEREGVS | 455 GISSSDGNT YYADSVKG |
| IL6RPMP108E9 | 201 EVQLVESGGGLVQAG GSLRLSCAFSRRSFG | 286 NFPMG | 371 WFRQRPG EEREYVA | 456 VISWNNNYI HYRDSVKG |

TABLE A-1-continued

Preferred combinations of CDR sequences

| Nanobody | SEQ ID | FR1 | SEQ ID | CDR 1 | SEQ ID | FR2 | SEQ ID | CDR 2 |
|---|---|---|---|---|---|---|---|---|
| IL6RPMP108F7 | 202 | EVQLVESGGGLVQAGGSLRLSCTASGRTFS | 287 | DYDMG | 372 | WFRQAPGKERECVA | 457 | VIDTNGDNTLTVGSVKG |
| IL6RPMP119A10 | 203 | EVQLVESGGGLVQPGGSLRLSCAASKSIFD | 288 | INAMY | 373 | WHRQAPGKQRESVA | 458 | SITSGGMRNYADSVKD |
| IL6RPMP120A1 | 204 | EVQLVESGGGLVQAGGSLSLSCATSGRTIS | 289 | DDTMA | 374 | WFRQAPGKEREFVA | 459 | TITFSGARTHYSDSVRD |
| IL6RPMP120A5 | 205 | EVQLVESGGGLVQAGGSLSLSCATSGRTIS | 290 | DDTMA | 375 | WFRQAPGKEREFVA | 460 | IITFNGARTHYSDSVRD |
| IL6RPMP120B2 | 206 | EVQLVESGGGLVQAGGSLSLSCATSGRTIS | 291 | DDTMA | 376 | WFRQAPGKEREFVA | 461 | TITFSGARTHYSDSVRD |
| IL6RPMP120B7 | 207 | EVQLVESGGGLVQAGGSLSLSCATSGRTIS | 292 | DDTMA | 377 | WFRQAPGKEREFVA | 462 | TITFSGARTHYSDSVRD |
| IL6RPMP120C1 | 208 | EVQLVESGGGLVQAGGSLSLSCATSGRTIS | 293 | DDTMA | 378 | WFRQAPGKEREFVA | 463 | TITFSGARTHYSDSVRD |
| IL6RPMP120C10 | 209 | EVQLVESGGGLVQAGGSLSLSCATSGRTIS | 294 | DDTMA | 379 | WFRQAPGKEREFVA | 464 | IITFNGARTHYSDSVRD |
| IL6RPMP120C11 | 210 | EVQLVESGGGLVQAGGSLSLSCATSGRTIS | 295 | DDTMA | 380 | WFRQAPGKEREFVA | 465 | TITFSGARTHYSDSVRD |
| IL6RPMP120C5 | 211 | EVQLVESGGRSVQAGGSLRLSCAASGRTFR | 296 | DYAMG | 381 | WFRQAPGKEREFVA | 466 | VISWSGAYTEYADSVKG |
| IL6RPMP120D2 | 212 | EVQLVESGGGLVQAGGSLSLSCATSGRTIS | 297 | DDTMA | 382 | WFRQAPGKEREFVA | 467 | TITFSGARTHYSDSVRD |
| IL6RPMP120F4 | 213 | EVQLVESGGGLVQTGGSLRLSCAVSGRTDS | 298 | TASVG | 383 | WFRQAPGKQREWVV | 468 | GISSGGSTHYADSVKG |
| IL6RPMP120G11 | 214 | EVQLVESGGGLVQAGGSVRLSCTASGGTLS | 299 | GNAMG | 384 | WFRQAPGTEREFVA | 469 | AITWSGDMSVYAEFVKG |
| IL6RPMP120G6 | 215 | EVQLVESGGDLVQTGGSLRLSCAASGITVS | 300 | DRAMG | 385 | WYRQAPGKQREMVA | 470 | GVSRGGMTSYADSVKG |
| IL6RPMP120H6 | 216 | EVQLVESGGGLVQPGGSLRLSCVVSGIIFS | 301 | DNAMG | 386 | WYRQYPGKQREWVA | 471 | GISRGGTTGYTDSVKG |

| Nanobody | SEQ ID | FR3 | SEQ ID | CDR 3 | SEQ ID | FR4 | SEQ ID |
|---|---|---|---|---|---|---|---|
| IL6RPMP100A10 | 472 | RFTISRDNAKNTGSLQMNSLKPEDTAVYYCAV | 557 | VQTTKGNYDY | 642 | WGQGTQVTVSS | 727 |
| IL6RPMP100A6 | 473 | RFTISRENAKNTLYLQMNHLKPEDTAVYYCAA | 558 | SSVFSDLRYRKNPKY | 643 | WGQGTQVTVSS | 728 |
| IL6RPMP100D11 | 474 | RFTISRENAKNTLYLQMNHLKPEDTAVYYCAA | 559 | SSVFSDLRYRKNPKY | 644 | WGQGTQVTVSS | 729 |
| IL6RPMP100G11 | 475 | RFTISRDNAKNTGSLQMNSLKPEDTAVYYCAV | 560 | VQTTRGNYDY | 645 | WGQGTQVTVSS | 730 |
| IL6RPMP101A1 | 476 | RFTISRGNAKNTVYLQMNSLKPEDTAVYYCAA | 561 | DLSLSKMVSKITSDMDY | 646 | WGKGTLVTVSS | 731 |
| IL6RPMP101A3 | 477 | RFAISSDNAKNTVYLQMNSLLPEDTAVYTCAA | 562 | GAWSALRRSVANY | 647 | WGQGTQVTVSS | 732 |
| IL6RPMP101A4 | 478 | RFTISRGNAKNTVYLQMNSLKPEDAAVYYCAA | 563 | DLSLSKMVSKITSDMDY | 648 | WGKGTLVTVSS | 733 |
| IL6RPMP101A5 | 479 | RFAISSDNAKNTVYLQMNSLLPEDTAVYTCAA | 564 | GVWSSLRHTAANY | 649 | WGQGTQVTVSS | 734 |
| IL6RPMP101B12 | 480 | RFTISRDKAKNTVYLQMNSLKPEDTAVYYCAA | 565 | TYLTAQAVGVPVAYYEFDY | 650 | WGQGTQVTVSS | 735 |

TABLE A-1-continued

Preferred combinations of CDR sequences

| | | | | | | |
|---|---|---|---|---|---|---|
| IL6RPMP101B2 | 481 | RFAISSDNAKNTVYLQMNSLLPEDTAVYTCAA | 566 | GAWSALRRSVANY | 651 | WGQGTQVTVSS 736 |
| IL6RPMP101B3 | 482 | RFTISRDNAKNTVYLQMNSLKPEDTAVYYCNA | 567 | LVVSHNYSDYVPFPDDY | 652 | WGQGTQVTVSS 737 |
| IL6RPMP101B6 | 483 | RFTISRDNAKNTVYLQMNSLKPEDATVYYCNA | 568 | IVTYSDYDLGNDY | 653 | WGQGTQVTVSS 738 |
| IL6RPMP101C2 | 484 | RFAISSDNAKNTVYLQMNSLLPEDTAVYTCAA | 569 | GVWSSLRHTAANY | 654 | WGQGTQVTVSS 739 |
| IL6RPMP101C3 | 485 | RFTISSDNAKNTVYLQMNSLKPEDTGVYYCAA | 570 | IWGIFFNEKMPVGAYDY | 655 | WGQGTQVTVSS 740 |
| IL6RPMP101D1 | 486 | RFAISSDNAKNTVYLQMNSLLPEDTAVYTCAA | 571 | GVWSSLRHTAANY | 656 | WGQGTQVTVSS 741 |
| IL6RPMP101D2 | 487 | RFTISSDNAKNTVYLQMNSLKPEDAGVYYCAA | 572 | IWGIFFNEKMPVGAYDY | 657 | WGQGTQVTVSS 742 |
| IL6RPMP101D6 | 488 | RFAISSDNAKNTVYLQMNSLLPEDTAVYTCAA | 573 | GVWSSLRHTAANY | 658 | WGQGTQVTVSS 743 |
| IL6RPMP101E1 | 489 | RFTISSDNAKNTVYLQMNSLKPEDTGVYYCAA | 574 | IWGIFFNEKMPVGAYDY | 659 | WGQGTQVTVSS 744 |
| IL6RPMP101F1 | 490 | RFTISSDNAKNTVYLQMNSLKPEDTGVYYCAA | 575 | IWGIFFNEKMPVGAYDY | 660 | WGQGTQVTVSS 745 |
| IL6RPMP101F2 | 491 | RFTISSDNAKNTVYLQMNSLKPEDTGVYYCAA | 576 | IWGIFFNEKMPVGAYDY | 661 | WGQGTQVTVSS 746 |
| IL6RPMP101F3 | 492 | RFTISSDNAKNTVYLQMNSLKPEDTGVYYCAA | 577 | IWGIFFNEKMPVGAYDY | 662 | WGQGTQVTVSS 747 |
| IL6RPMP101F6 | 493 | RFTISRDNAKNTVYLQMNSLKPEDTAVFYCNA | 578 | IVTDSDYDLGNDY | 663 | WGQGTQVTVSS 748 |
| IL6RPMP101G1 | 494 | RFTVSRDKAKNTVYLQMNSLKPEDTAVYYCAF | 579 | VFTTAQAMGVPNNPYEYDF | 664 | WGQGTQVTVSS 749 |
| IL6RPMP101G11 | 495 | RFTISRDNAKNTVYLQMNSLNPEDTGVYTCAA | 580 | VLTTAQAMGVPTRSYEYDY | 665 | WGQGTQVTVSS 750 |
| IL6RPMP101G2 | 496 | RFTISRDNAKNTVYLQMNSLKPEDTAVYYCNA | 581 | LVVSHNYSDYVPFPDDY | 666 | WGQGTQVTVSS 751 |
| IL6RPMP101G3 | 497 | RFAISSDNAKNTVYLQMNSLLPEDTAVYTCAA | 582 | GVWSSLRHTAANY | 667 | WGQGTQVTVSS 752 |
| IL6RPMP101G4 | 498 | RFTISSDNAKNTVYLQMNSLKPEDTGVYYCAA | 583 | IWGIFFNEKMPVGAYDY | 668 | WGQGTQVTVSS 753 |
| IL6RPMP101H3 | 499 | RFTISSDNAKNTVYLQMNSLKPEDTGVYYCAA | 584 | IWGIFFNEKMPVGAYDY | 669 | WGQGTQVTVSS 754 |
| IL6RPMP101H6 | 500 | RFAISSDNAKNTVYLQMNSLLPEDTAVYTCAA | 585 | GAWSALRRSVANY | 670 | WGQGTQVTVSS 755 |
| IL6RPMP102G3 | 501 | RFTISNDNAKNTVYLQMNSLKPEDTAVYYCNA | 586 | YQAGWGDY | 671 | WGQGTQVTVSS 756 |
| IL6RPMP103A2 | 502 | QFTITRDIDENTVYLQMNSLKPEDTAVYYCLT | 587 | RASVPGRGYQDY | 672 | WGQGTQVTVSS 757 |
| IL6RPMP103A4 | 503 | RFTITRDIDENTVYLQMNSLKPEDTAVYYCLT | 588 | RASVPGRGYQDY | 673 | WGQGTQVTVSS 758 |
| IL6RPMP103A5 | 504 | RFTISRDNAKNTVYLQMNSLKPEDTAVYYCAA | 589 | DPRRIGANIKYSDY | 674 | WGQGTQVTVSS 759 |
| IL6RPMP103B2 | 505 | RFTISRDYAENSVDLQMNSLKPEDTAVYYCNA | 590 | RGTYLNGDHYSTNYS | 675 | WGQGTQVTVSS 760 |

TABLE A-1-continued

| | | | | | |
|---|---|---|---|---|---|
| IL6RPMP103C3 | 506 RFTISRDNTKNTVSLQ MENLKPEDTGVYYCNI | 591 DEGMDYDG NFYDR | 676 | WGQGTQ VTVSS | 761 |
| IL6RPMP103C4 | 507 RFTASRDNAKNVYLQ MNRLEPEDTAVYYCAA | 592 DPPPFASD YSAPQSYDY | 677 | WGQGTQ VTVSS | 762 |
| IL6RPMP103C7 | 508 RFTISRDNAKNTVYLQ MDSLKSEDTAVYYCAA | 593 STKYYSST YNYIHPAF YDI | 678 | WGQGTQ VTVSS | 763 |
| IL6RPMP103D7 | 509 RFTASRDNAKNTVYLQ MNRLEPEDTAVYYCAA | 594 DPPPFASD YSAPQSYDY | 679 | WGQGTQ VTVSS | 764 |
| IL6RPMP103F2 | 510 RFTISRDISRKTLYLQ MNSLRPEDTATYTCAR | 595 GIYFSRRY VDPGIYGT | 680 | WGQGTQ VTVSS | 765 |
| IL6RPMP103H9 | 511 RFTISKDNAKNTVYLQ MNGLKPDDTAVYYCGL | 596 GRYEGGVW RDY | 681 | WGQGTQ VTVSS | 766 |
| IL6RPMP104A8 | 512 RFAISSDNAKNTVYLQ MNSLVPEDTAVYTCAA | 597 GAWSSLRK TAASY | 682 | WGQGTQ VTVSS | 767 |
| IL6RPMP104B8 | 513 RFTISSDNAKNTVYLQ MNSLKPEDTGVYYCAA | 598 IWGIFFNE KMPVGAYDY | 683 | WGQGTQ VTVSS | 768 |
| IL6RPMP104B9 | 514 RFAISSDNAKNTVYLQ MNSLLPEDTAVYTCAA | 599 GVWSSLRH TAANY | 684 | WGQGTQ VTVSS | 769 |
| IL6RPMP104E4 | 515 RFTISRGNAKNTVYLQ MNSLKPEDTAVYYCAA | 600 DLSLSKMV SKITSDMDY | 685 | WGKGTL VTVSS | 770 |
| IL6RPMP104E7 | 516 RFTISRDNAKDTVYLQ MNSLKPEDTAVYYCNA | 601 HIRFPFPN DY | 686 | WGQGTQ VTVSS | 771 |
| IL6RPMP105B8 | 517 RFTISSDNAKNTVYLQ MNSLKPEDTGVYYCAA | 602 IWGIFFNE KMPVGAYDY | 687 | WGQGTQ VTVSS | 772 |
| IL6RPMP105C2 | 518 RFTISRDNAKNTVYLQ MNSLKPEDTAVYYCNA | 603 LVVSENYS DYVPFPDDY | 688 | WGQGTQ VTVSS | 773 |
| IL6RPMP105D3 | 519 RFTISRDNAKNTVYLQ MNSLKPEDTAVYYCNA | 604 LVVSHNYS DYVPFPDDY | 689 | WGQGTQ VTVSS | 774 |
| IL6RPMP105E1 | 520 RFTISRDNAKNTVYLQ MNSLKPEDTAVFYCNA | 605 IVTDSDYD LGNDY | 690 | WGQGTQ VTVSS | 775 |
| IL6RPMP105E11 | 521 RFTISSDNAKNTVYLQ MNGLKPEDTGVYYCAA | 606 IWGIFFNE KMPVGAYDY | 691 | WGQGTQ VTVSS | 776 |
| IL6RPMP105H10 | 522 RFTISSDNAKNTVYLQ MNSLKPEDAGVYYCAA | 607 IWGIFFNE KMPVGAYDY | 692 | WGQGTQ VTVSS | 777 |
| IL6RPMP106B2 | 523 RFTISRDNAKNTVYLQ MNSLKPEDTAVYYCNA | 608 LVVSHNYS DYVPFPDDY | 693 | WGQGTQ VTVSS | 778 |
| IL6RPMP106D6 | 524 RFTISSDNAKNTVYLQ MDSLKPEDTAVYYCAA | 609 DLSLYGCY VGDRDLYD YDY | 694 | WGQGTQ VTVSS | 779 |
| IL6RPMP106F4 | 525 RFTISRDNAKNTVYLQ MNSLKPGDTAVYYCNA | 610 LVVSHNYS DYVPFPDDY | 695 | WGQGTQ VTVSS | 780 |
| IL6RPMP106F7 | 526 RFTISRDNAKNTVYLQ MNSLKPEDTAVYYCNA | 611 LVVSHNYS DYVPFPDDY | 696 | WGQGTQ VTVSS | 781 |
| IL6RPMP107A1 | 527 RFAISRDGAKNTVHLR MSSLKPEDTAVYYCNA | 612 YQAGWGDY | 697 | WGQGTQ VTVSS | 782 |
| IL6RPMP107A9 | 528 RFTISTDNAKNTVYLQ MNNLKPEDTAVYYCAA | 613 NVGVTGSY EY | 698 | WGQGTQ VTVSS | 783 |
| IL6RPMP107B4 | 529 RFTISGDNAKNTVYLQ MNSLKPEDTGVYFCAA | 614 GYMSGAES PIGYDN | 699 | WGQGTQ VTVSS | 784 |
| IL6RPMP107C3 | 530 RFAISRDGAKNTVHLR MSSLKPEDTAVYYCNA | 615 YQAGWGDY | 700 | WGQGTQ VTVSS | 785 |

TABLE A-1-continued

Preferred combinations of CDR sequences

| | | | | | | |
|---|---|---|---|---|---|---|
| IL6RPMP107E4 | 531 | RFTISNDNAKNTVYLQMNSLKPEDTAVYYCNA | 616 | YQAGWGDY | 701 | WGQGTQVTVSS | 786 |
| IL6RPMP107G10 | 532 | RFTISNDNAKNTVYLQMNSLKPEDTAVYYCNA | 617 | YQAGWGDY | 702 | WGQGTQVTVSS | 787 |
| IL6RPMP107H2 | 533 | RFTASRDNAKNTLYLQMNSLKPEDTAVYYCTN | 618 | SNRYDYADFSAV | 703 | RGQGTQVTVSS | 788 |
| IL6RPMP107H5 | 534 | RFAISRDGAKNTVHLRMSSLKPEDTAVYYCNA | 619 | YQAGWGDY | 704 | WGQGTQVTVSS | 789 |
| IL6RPMP108C10 | 535 | RFAISRDNAKNTVYLQMNSLLPEDTAVYTCAA | 620 | GAWSSLRSTAANY | 705 | WGQGTQVTVSS | 790 |
| IL6RPMP108C9 | 536 | RFNISRDNRENTVYLQMNSLKPEDTAVYYCAA | 621 | NTYYSGAYFPRGHEWYEY | 706 | WGQGTQVTVSS | 791 |
| IL6RPMP108D1 | 537 | RFAISRDNAKNTVYLQMNSLLPEDTAVYTCAA | 622 | GAWSSLRSTAANY | 707 | WGQGTKVTVSS | 792 |
| IL6RPMP108D10 | 538 | RFAISRDNAKNTVYLQMNSLLPEDTAVYTCAA | 623 | GAWSSLRSTAANY | 708 | WGQGTQVTVSS | 793 |
| IL6RPMP108D2 | 539 | RFTISSDNAKNTVYLQMNSLKPEDTAVYYCAA | 624 | EPPDSSWYLDGSPEFFKY | 709 | WGQGTQVTVSS | 794 |
| IL6RPMP108E1 | 540 | RFTISSDNAKNTVYLQMNSLKPEDTAVYYCAA | 625 | EPPDSSWYLDGSPEFFKY | 710 | WGQGTQVTVSS | 795 |
| IL6RPMP108E9 | 541 | RFTASRDTSENRMYLQMNGLKPEDTAVYYCAA | 626 | RTKDNTLFTPAEEYDY | 711 | WGQGTQVTVSS | 796 |
| IL6RPMP108F7 | 542 | RFAISRDNAKNTVYLQMNSLLPEDTAVYTCAA | 627 | GAWSSLRSTAANY | 712 | WGQGTQVTVSS | 797 |
| IL6RPMP119A10 | 543 | RFTISKDNAKNTVYLQMNGLKPDDTAVYYCGL | 628 | GRYEGGVWRDY | 713 | WGQGTQVTVSS | 798 |
| IL6RPMP120A1 | 544 | RFTISRDNAKNTVYLQMNSLKSEDTAVYYCAA | 629 | STKYYSSTYNYIHPAFYDI | 714 | WGQGTQVTVSS | 799 |
| IL6RPMP120A5 | 545 | RFTISRDNAKNTVYLQMNSLKSEDTAVYYCAA | 630 | STKYYSSTYNYIHPAFYDI | 715 | WGQGTQVTVSS | 800 |
| IL6RPMP120B2 | 546 | RFTISRDNAKNTVYLQMNSLKSEDTAVYYCAA | 631 | STKYYSSTYNYTHPAFYDI | 716 | WGQGTQVTVSS | 801 |
| IL6RPMP120B7 | 547 | RFTISRDNAKNTVYLQMNSLKSEDTAVYYCAA | 632 | STKYYSSTYNYIHPAFYDI | 717 | WGQGTQVTVSS | 802 |
| IL6RPMP120C1 | 548 | RFTISRDNAKNTVYLQMNSLKSEDTAVYYCAA | 633 | STKYYSSTYNYIHPAFYDI | 718 | WGQGTQVTVSS | 803 |
| IL6RPMP120C10 | 549 | RFTISRDNAKNTVYLQMNSLKSEDTAVYYCAA | 634 | STKYYSSTYNYIHPAFYDI | 719 | WGQGTQVTVSS | 804 |
| IL6RPMP120C11 | 550 | RFTISRDNAKNTVYLQMNSLKSEDTAVYYCAA | 635 | STKYYSSTYNYIHPAFYDI | 720 | WGQGTQVTVSS | 805 |
| IL6RPMP120C5 | 551 | RFTISRNNAANTGALQMNSLKLEDTAVYYCAA | 636 | TMVPRAMVVDEFEY | 721 | WGQGTQVTVSS | 806 |
| IL6RPMP120D2 | 552 | RFTISRDNAKNTVYLQMNSLKSEDTAVYYCAA | 637 | STKYYSSTYNYIHPAFYDI | 722 | WGQGTQVTVSS | 807 |

TABLE A-1-continued

| Preferred combinations of CDR sequences | | | | | | |
|---|---|---|---|---|---|---|
| IL6RPMP120F4 | 553 | RFISSQDDAKNTVYLQMNSLKPEDTAIYYCAI | 638 | AHGSSTYNY | 723 | WGQGTQVTVSS | 808 |
| IL6RPMP120G11 | 554 | RFTVSRDNAKSVVYLQMNRLKPEDTSVYYCAG | 639 | DIRGRENFGS | 724 | WGQGTQVTVSS | 809 |
| IL6RPMP120G6 | 555 | RLTISRDNAKNSVYLQMNSLNPEDTAVYYCSA | 640 | YYRYGSSVPQY | 725 | WGQGTQVTVSS | 810 |
| IL6RPMP120H6 | 556 | RFTISRDNAKNTVYLQMNSLKPEDTAVYYCAI | 641 | PTENQPDH | 726 | WGQGTQVTVSS | 811 |

TABLE A-2

Amino acid sequences that make up the reference compounds

REFERENCE IGG HEAVY CHAIN, SEQ ID NO: 126
QVQLQESGPGLVRPSQTLSLTCTVSGYSITSDHAWSWVRQPPGRGLEWIG

YISYSGITTYNPSLKSRVTMLRDTSKNQFSLRLSSVTAADTAVYYCARSL

ARTTAMDYWGQGSLVTVSSASTKGPSVFPLAPSSKSTSGGTAALGCLVKD

YFPEPVTVSWNSGALTSGVHTFPAVLQSSGLYSLSSVVTVPSSSLGTQTY

ICNVNHKPSNTKVDKKVEPKSCDKTHTCPPCPAPELLGGPSVFLFPPKPK

DTLMISRTPEVTCVVVDVSHEDPEVKFNWYVDGVEVHNAKTKPREEQYNS

TYRVVSVLTVLHQDWLNGKEYKCKVSNKALPAPIEKTISKAKGQPREPQV

YTLPPSRDELTKNQVSLTCLVKGFYPSDIAVEWESNGQPENNYKTTPPVL

DSDGSFFLYSKLTVDKSRWQQGNVFSCSVMHEALHNHYTQKSLSLSPGK

REFERENCE IGG LIGHT CHAIN, SEQ ID NO: 127
DIQMTQSPSSLSASVGDRVTITCRASQDISSYLNWYQQKPGKAPKLLIYY

TSRLHSGVPSRFSGSGSGTDFTFTISSLQPEDIATYYCQQGNTLPYTFGQ

GTKVEIKRTVAAPSVFIFPPSDEQLKSGTASVVCLLNNFYPREAKVQWKV

DNALQSGNSQESVTEQDSKDSTYSLSSTLTLSKADYEKHKVYACEVTHQG

LSSPVTKSFNRGEC

TABLE A-2-continued

Amino acid sequences that make up the reference compounds

REFERENCE FAB HEAVY CHAIN, SEQ ID NO: 128
QVQLQESGPGLVRPSQTLSLTCTVSGYSITSDHAWSWVRQPPGRGLEWIG

YISYSGITTYNPSLKSRVTMLRDTSKNQFSLRLSSVTAADTAVYYCARSL

ARTTAMDYWGQGSLVTVSSASTKGPSVFPLAPSSKSTSGGTAALGCLVKD

YFPEPVTVSWNSGALTSGVHTFPAVLQSSGLYSLSSVVTVPSSSLGTQTY

ICNVNHKPSNTKVDKKVEPKSC

REFERENCE FAB LIGHT CHAIN, SEQ ID NO: 129
DIQMTQSPSSLSASVGDRVTITCRASQDISSYLNWYQQKPGKAPKLLIYY

TSRLHSGVPSRFSGSGSGTDFTFTISSLQPEDIATYYCQQGNTLPYTFGQ

GTKVEIKRTVAAPSVFIFPPSDEQLKSGTASVVCLLNNFYPREAKVQWKV

DNALQSGNSQESVTEQDSKDSTYSLSSTLTLSKADYEKHKVYACEVTHQG

LSSPVTKSFNRGEC

IL6R300, SEQ ID NO: 130
EVQLVESGGGLVQPGGSLRLSCAASGSVFKINVMAWYRQAPGKGRELVAG

IISGGSTSYADSVKGRFTISRDNAKNTLYLQMNSLRPEDTAVYYCAFITT

ESDYDLGRRYWGQGTLVTVSS

TABLE A-3

Protein sequences of monovalent anti-IL-6R Nanobodies

>IL6RPMP100A10, SEQ ID NO: 132
EVQLVESGGGLVQAGGSLRLSCAASGRGFSPYTMGWFRQAPGKERVFVAGISWSTGIAHYTD

SVKGRFTISRDNAKNTGSLQMNSLKPEDTAVYYCAVVQTTKGNYDYWGQGTQVTVSS

>IL6RPMP100A6, SEQ ID NO: 133
EVQLVESGGGLVQAGDSLRLSCLASGRSFKDDAMGWFRQAPGKEREFVSGIDWRGNIVDAES

VKGRFTISRENAKNTLYLQMNHLKPEDTAVYYCAASSVFSDLRYRKNPKYWGQGTQVTVSS

>IL6RPMP100D11, SEQ ID NO: 134
EVQLVESGGGLVQAGDSLRLSCLASGRSFKDDAMGWFRQAPGKEREFVSGIDWRGNIVDAES

VKGRFTISRENAKNTLYLQMNHLKPEDTAVYYCAASSVFSDLRYRKNPKYWGQGTQVTVSS

>IL6RPMP100G11, SEQ ID NO: 135
EVQLVESGGGLVQAGGSLRLSCAASGRGFSPYTMGWFRQAPGKERVFVAGISWSTGIAHYTD

SVKGRFTISRDNAKNTGSLQMNSLKPEDTAVYYCAVVQTTKGNYDYWGQGTQVTVSS

>IL6RPMP101A1, SEQ ID NO: 136
EVQLVESGGGTVQAGGSLKLSCAASGRTFTNYAMGWFRQAPGKEREFVAAIAYATHFADSVK

TABLE A-3-continued

Protein sequences of monovalent anti-IL-6R Nanobodies

GRFTISRGNAKNTVYLQMNSLKPEDTAVYYCAADLSLSKMVSKITSDMDYWGKGTLVTVSS

>IL6RPMP101A3, SEQ ID NO: 137
EVQLVESGGGLVQAGGPLRLSCTASGRTFTDYDMGWFRQAPGKEREVVAIIDTNGDNTLTVG

SVKGRFAISSDNAKNTVYLQMNSLLPEDTAVYTCAAGAWSALRRSVANYWGQGTQVTVSS

>IL6RPMP101A4, SEQ ID NO: 138
EVQLVESGGGTVQAGGSLKLSCAASGRTFTNYAMGWFRQAPGKEREFVAAIAYATHFADSVK

GRFTISRGNAKNTVYLQMNSLKPEDAAVYYCAADLSLSKMVSKITSDMDYWGKGTLVTVSS

>IL6RPMP101A5, SEQ ID NO: 139
EVQLVESGGGLVQAGGSLRLSCTASGRTFSDYDMGWFRQAPGKERECVAIIDTNGDNTLIVG

SVKGRFAISSDNAKNTVYLQMNSLLPEDTAVYTCAAGVWSSLRHTAANYWGQGTQVTVSS

>IL6RPMP101B12, SEQ ID NO: 140
EVQLVESGGGLVQPGGSLRLSCAASGVTLDYYAIGWFRQAPGKEREGVSSISSNDGSTFYAD

SVKGRFTISRDKAKNTVYLQMNSLKPEDTAVYYCAATYLTAQAVGVPVAYYEFDYWGQGTQVTVSS

>IL6RPMP101B2, SEQ ID NO: 141
EVQLVESGGGLVQAGGSLRLSCTASGRTFTDYDMGWFRQAPGKEREVVAIIDTNGDNTLTVG

SVKGRFAISSDNAKNTVYLQMNSLLPEDTAVYTCAAGAWSALRRSVANYWGQGTQVTVSS

>IL6RPMP101B3, SEQ ID NO: 142
EVQLVESGGGLVQAGGSLRLSCAASGSIFRINAMGWYRQAPGKQRELVAAAISGGSTNYADF

VKGRFTISRDNAKNTVYLQMNSLKPEDTAVYYCNALVVSHNYSDYVPFPDDYWGQGTQVTVSS

>IL6RPMP101B6, SEQ ID NO: 143
EVQLVESGGGLVQAGGSLRLSCAASGSDFSIKAMGWYRQAPGKQRELVARITSGGSTVYADS

VKGRFTISRDNAKNTVYLQMNSLKPEDATVYYCNAIVTYSDYDLGNDYWGQGTQVTVSS

>IL6RPMP101C2, SEQ ID NO: 144
EVQLVESGGGLVQAGGSLRLSCTASGRTFSDYDMGWFRQAPGKERECVAIIDTNGDNTLIVG

SVKGRFAISSDNAKNTVYLQMNSLLPEDTAVYTCAAGVWSSLRHTAANYWGQGTQVTVSS

>IL6RPMP101C3, SEQ ID NO: 145
EVQLVESGGGLVRAGGSLRLSCAASGFAFDDYAIGWFRQAPGKEREGVSSISSSNGNTYYAD

SVRGRFTISSDNAKNTVYLQMNSLKPEDTGVYYCAAIWGIFFNEKMPVGAYDYWGQGTQVTVSS

>IL6RPMP101D1, SEQ ID NO: 146
EVQLVESGGGLVQAGGSLRLSCTASGRTFSDYDMGWFRQAPGKERECVAIIDTNGDNTLIVG

SVKGRFAISSDNAKNTVYLQMNSLLPEDTAVYTCAAGVWSSLRHTAANYWGQGTQVTVSS

>IL6RPMP101D2, SEQ ID NO: 147
EVQMVESGGGLVQAGGSLRLSCAASGFAFDDYAIGWFRQAPGKEREGVSSISSSNGNTYYAD

SVRGRFTISSDNAKNTVYLQMNSLKPEDAGVYYCAAIWGIFFNEKMPVGAYDYWGQGTQVTVSS

>IL6RPMP101D6, SEQ ID NO: 148
EVQLVESGGGLVQAGGSLRLSCTASGRTFSDYDMGWFRQAPGKERECVAIIDTNGDNTLIVG

SVKGRFAISSDNAKNTVYLQMNSLLPEDTAVYTCAAGVWSSLRHTAANYWGQGTQVTVSS

>IL6RPMP101E1, SEQ ID NO: 149
EVQLVESGGGLVQAGGSLRLSCAASGFAFDDYAIGWFRQAPGKEREGVSSISSSNGNTYYAD

SVRGRFTISSDNAKNTVYLQMNSLKPEDTGVYYCAAIWGIFFNEKMPVGAYDYWGQGTQVTVSS

>IL6RPMP101F1, SEQ ID NO: 150
EVQLVESGGGLVQAGGSLRLSCAASGFAFDDYAIGWFRQAPGKEREGVSSISSSNGNTYYAD

SVRGRFTISSDNAKNTVYLQMNSLKPEDTGVYYCAAIWGIFFNEKMPVGAYDYWGQGTQVTVSS

>IL6RPMP101F2, SEQ ID NO: 151
EVQLVESGGGLVQAGGSLRLSCAASGFAFDDYAIGWFRQAPGKEREGVSSISSSNGNTYYAD

SVRGRFTISSDNAKNTVYLQMNSLKPEDTGVYYCAAIWGIFFNEKMPVGAYDYWGQGTQVTVSS

TABLE A-3-continued

Protein sequences of monovalent anti-IL-6R Nanobodies

>IL6RPMP101F3, SEQ ID NO: 152
EVQLVESGGGLVQAGGSLRLSCAASGFAFDDYAIGWFRQAPGKEREGVSSISSSNGNTYYAD

SVRGRFTISSDNAKNTVYLQMNSLKPEDTGVYYCAAIWGIFFNEKMPVGAYDYWGQGTQVTVSS

>IL6RPMP101F6, SEQ ID NO: 153
EVQLVESGGGLVQAGGSLRLSCAASGSIFSIKAMGWYRQAPGKQRELVARITSGGSTYYADS

VKGRFTISRDNAKNTVYLQMNSLKPEDTAVFYCNAIVTDSDYDLGNDYWGQGTQVTVSS

>IL6RPMP101G1, SEQ ID NO: 154
EVQLVESGGGLVQPGGSLRLSCAASGGTLDYYAIGWFRQAPGKEREGVSCISSSDGSTYYAS

SVKGRFTVSRDKAKNTVYLQMNSLKPEDTAVYYCAFVFTTAQAMGVPNNPYEYDFWGQGTQVTVSS

>IL6RPMP101G11, SEQ ID NO: 155
EVQLVESGGGLVQPGGSLRLSCAASASGFTLDYYAIGWFRQAPGKEREGVSCISSTDGSTYY

ADSVKGRFTISRDNAKNTVYLQMNSLNPEDTGVYTCAAVLTTAQAMGVPTRSYEYDYWGQGTQVTVSS

>IL6RPMP101G2, SEQ ID NO: 156
EVQLVESGGGLVQAGGSLRLSCAASGSIFRINAMGWYRQAPGKQRELVAAAISGGSTNYADF

VKGRFTISRDNAKNTVYLQMNSLKPEDTAVYYCNALVVSHNYSDYVPFPDDYWGQGTQVTVSS

>IL6RPMP101G3, SEQ ID NO: 157
EVQLVESGGGLVQAGGSLRLSCTASGRTFSDYDMGWFRQAPGKERECVAIIDTNGDNTLIVG

SVKGRFAISSDNAKNTVYLQMNSLLPEDTAVYTCAAGVWSSLRHTAANYWGQGTQVTVSS

>IL6RPMP101G4, SEQ ID NO: 158
EVQLVESGGGLVQAGGSLRLSCAASGFAFDDYAIGWFRQAPGKEREGVSSISSSNGNTYY

ADSVRGRFTISSDNAKNTVYLQMNSLKPEDTGVYYCAAIWGIFFNEKMPVGAYDYWGQGTQVTVSS

>IL6RPMP101H3, SEQ ID NO: 159
EVQLVESGGGLVQAGGSLRLSCAASGFAFDDYAIGWFRQAPGKEREGVSSISSSNGNTYY

ADSVRGRFTISSDNAKNTVYLQMNSLKPEDTGVYYCAAIWGIFFNEKMPVGAYDYWGQGTQVTVSS

>IL6RPMP101H6, SEQ ID NO: 160
EVQLVESGGGLVQAGGSLRLSCTASGRTFTDYDMGWFRQAPGKEREVVAIIDTNGDNTLT

VGSVKGRFAISSDNAKNTVYLQMNSLLPEDTAVYTCAAGAWSALRRSVANYWGQGTQVTVSS

>IL6RPMP102G3, SEQ ID NO: 161
EVQLVESGGGLVQAGGSLRLSCAASGSIDRINAMGWYRQAPGKQRDFLAVITDGDKTLYA

DSVKGRFTISNDNAKNTVYLQMNSLKPEDTAVYYCNAYQAGWGDYWGQGTQVTVSS

>IL6RPMP103A2, SEQ ID NO: 162
EVQLVESGGGLVQPGGSLRLSCAASGSIFSINTMGWYRQVPGKQRELVATVRSGSITNYA

DSVQDQFTITRDIDENTVYLQMNSLKPEDTAVYYCLTRASVPGRGYQDYWGQGTQVTVSS

>IL6RPMP103A4, SEQ ID NO: 163
EVQLVESGGGLVQPGGSLRLSCAASGSIFSINTMGWYRQVPGKQRELVATVRSGSITNYA

DSVQDRFTITRDIDENTVYLQMNSLKPEDTAVYYCLTRASVPGRGYQDYWGQGTQVTVSS

>IL6RPMP103A5, SEQ ID NO: 164
EVQLVESGGGLVQAGDSLRLSCVASGLPFSTLHMGWFRQAPGKEHESVSAISSDGGSEYY

AGSVKGRFTISRDNAKNTVYLQMNSLKPEDTAVYYCAADPRRIGANIKYSDYWGQGTQVTVSS

>IL6RPMP103B2, SEQ ID NO: 165
EVQLVESGGGLVQPGGSLRLSCAASGSTFSINMMAWYCQAPGKQRELVASISSGGGINYA

DSVKGRFTISRDYAENSVDLQMNSLKPEDTAVYYCNARGTYLNGDHYSTNYNSWGQGTQVTVSS

>IL6RPMP103C3, SEQ ID NO: 166
EVQLVESGGGLVQPGGSMRLSCAATGAIFSISTMGWYRQAPGAQREFVAGVGLDGTPNYA

DSVKGRFTISRDNTKNTVSLQMENLKPEDTGVYYCNIDEGMDYDGNFYDRWGQGTQVTVSS

>IL6RPMP103C4, SEQ ID NO: 167
EVQLVESGGGLVEAGGSLRLSCAAAGRTLSSYSMAWFRQAPGKEREFVAIIRGNPSRTYH

TABLE A-3-continued

Protein sequences of monovalent anti-IL-6R Nanobodies

SDSVKGRFTASRDNAKNTVYLQMNRLEPEDTAVYYCAADPPPFASDYSAPQSYDYWGQGTQVTVSS

>IL6RPMP103C7, SEQ ID NO: 168
EVQLVESGGGLVQAGGSLSLSCATSGRTISDDTMAWFRQAPGKEREFVATITFSGARTHY

SDSVRDRFTISRDNAKNTVYLQMDSLKSEDTAVYYCAASTKYYSSTYNYIHPAFYDIWGQGTQVTVSS

>IL6RPMP103D7, SEQ ID NO: 169
EVQLVESGGGLVEAGGSLRLSCAAAGRTLSSYSMAWFRQAPGKEREFVAIIRGNPSRTYH

SDSVKGRFTASRDNAKNTVYLQMNRLEPEDTAVYYCAADPPPFASDYSAPQSYDYWGQGTQVTVSS

>IL6RPMP103F2, SEQ ID NO: 170
EVQLVESGGGLVQAGGSLRLSCVASGHTSDTYIMAWFRQAPGKEREFVASILWDGSITYY

ADSVKDRFTISRDISRKTLYLQMNSLRPEDTATYTCARGIYFSRRYVDPGIYGTWGQGTQVTVSS

>IL6RPMP103H9, SEQ ID NO: 171
EVQLVESGGGLVQPGGSLRLSCAASKSIFDINAMYWHRQAPGKQRESVASITSGGMRNYA

DSVKDRFTISKDNAKNTVYLQMNGLKPDDTAVYYCGLGRYEGGVWRDYWGQGTQVTVSS

>IL6RPMP104A8, SEQ ID NO: 172
EVQLVESGGGLVQAGGSLRLSCTASGRTFSDYDMGWFRQAPGKEREFVAVIDTNGGHTLT

VGSVKGRFAISSDNAKNTVYLQMNSLVPEDTAVYTCAAGAWSSLRKTAASYWGQGTQVTVSS

>IL6RPMP104B8, SEQ ID NO: 173
EVQLVESGGGLVQAGGSLRLSCAASGFAFDDYAIGWFRQAPGKEREGVSSISSSNGNTYY

ADSVRGRFTISSDNAKNTVYLQMNSLKPEDTGVYYCAAIWGIFFNEKMPVGAYDYWGQGTQVTVSS

>IL6RPMP104B9, SEQ ID NO: 174
EVQLVESGGGLVQAGGSLRLSCTASGRTFSDYDMGWFRQAPGKERECVAIIDTNGDNTLI

VGSVKGRFAISSDNAKNTVYLQMNSLLPEDTAVYTCAAGVWSSLRHTAANYWGQGTQVTVSS

>IL6RPMP104E4, SEQ ID NO: 175
EVQLVESGGGTVQAGGSLKLSCAASGRTFTNYAMGWFRQAPGKEREFVAAIAYATHFADS

VKGRFTISRGNAKNTVYLQMNSLKPEDTAVYYCAADLSLSKMVSKITSDMDYWGKGTLVTVSS

>IL6RPMP104E7, SEQ ID NO: 176
EVQLVESGGGLVQAGGSLRLSCAAGGSIFSINAMGWYRQAPGKQRELVASITSGGSTTYA

DSVKGRFTISRDNAKDTVYLQMNSLKPEDTAVYYCNAHIRFPFPNDYWGQGTQVTVSS

>IL6RPMP105B8, SEQ ID NO: 177
EVQLVESGGGLVRAGGSLRLSCAASGFAFDDYAIGWFRQAPGKEREGVSSISSSNGNTYY

ADSVRGRFTISSDNAKNTVYLQMNSLKPEDTGVYYCAAIWGIFFNEKMPVGAYDYWGQGTQVTVSS

>IL6RPMP105C2, SEQ ID NO: 178
EVQLVESGGGLVQAGGSLRLSCAASGSIFRINAMGWYRQAPGEQRELVAAAISGGSTNYA

DFVKGRFTISRDNAKNTVYLQMNSLKPEDTAVYYCNALVVSHNYSDYVPFPDDYWGQGTQVTVSS

>IL6RPMP105D3, SEQ ID NO: 179
EVQLEESGGGLVQAGGSLRLSCAASGSIFRINAMGWYRQAPGKQRELVAAAISGGSTNYA

DFVKGRFTISRDNAKNTVYLQMNSLKPEDTAVYYCNALVVSHNYSDYVPFPDDYWGQGTQVTVSS

>IL6RPMP105E1, SEQ ID NO: 180
EVQLVESGGGLVQAGGSLRLSCAASGSIFSIKAMGWYRQAPGKQRELVARITSGGSTYYA

DSVKGRFTISRDNAKNTVYLQMNSLKPEDTAVFYCNAIVTDSDYDLGNDYWGQGTQVTVSS

>IL6RPMP105E11, SEQ ID NO: 181
EVQLVESGGGLVQAGGSLRLSCAASGFAFDDYAIGWFRQAPGKEREGVSSISSSNGNTYY

ADSVRGRFTISSDNAKNTVYLQMNGLKPEDTGVYYCAAIWGIFFNEKMPVGAYDYWGQGTQVTVSS

>IL6RPMP105H10, SEQ ID NO: 182
EVQMVESGGGLVQAGGSLRLSCAASGFAFDDYAIGWFRQAPGKEREGVSSISSSNGNTYY

ADSVRGRFTISSDNAKNTVYLQMNSLKPEDAGVYYCAAIWGIFFNEKMPVGAYDYWGQGTQVTVSS

>IL6RPMP106B2, SEQ ID NO: 183

TABLE A-3-continued

Protein sequences of monovalent anti-IL-6R Nanobodies

EVQLVESGGGLVQAGGSLRLSCAASGSIFRINAMGWYRQAPGKQRELVAAAISGGSTNYA

DFVKGRFTISRDNAKNTVYLQMNSLKPEDTAVYYCNALVVSHNYSDYVPFPDDYWGQGTQVTVSS

>IL6RPMP106D6, SEQ ID NO: 184
EVQLVESGGGLVQAGGSLRLSCAASGFTFDDYAIGWFRQAPGKEREGVSCMISSDGSTYY

ADSVKGRFTISSDNAKNTVYLQMDSLKPEDTAVYYCAADLSLYGCYVGDRDLYDYDYWGQGTQVTVSS

>IL6RPMP106F4, SEQ ID NO: 185
EVQLVESGGGLVQAGGSLRLSCAASGSIFRINAMGWYRQAPGKQRELVAAAISGGSTNYA

DFVKGRFTISRDNAKNTVYLQMNSLKPGDTAVYYCNALVVSHNYSDYVPFPDDYWGQGTQVTVSS

>IL6RPMP106F7, SEQ ID NO: 186
EVQLVESEGGLVQAGGSLRLSCAASGSIFRINAMGWYRQAPGKQRELVAAAISGGSTNYA

DFVKGRFTISRDNAKNTVYLQMNSLKPEDTAVYYCNALVVSHNYSDYVPFPDDYWGQGTQVTVSS

>IL6RPMP107A1, SEQ ID NO: 187
EVQLVESGGGLVQAGGSLNLSCNASGDIGSINAMGWYRQAPGQQREWVAVITDTDSTIYP

DSVKGRFAISRDGAKNTVHLRMSSLKPEDTAVYYCNAYQAGWGDYWGQGTQVTVSS

>IL6RPMP107A9, SEQ ID NO: 188
EVQLVESGGGLVQAGGSLRLSCAASGGIFSDMFMGWFRQAPGKSRESVARISPSGNTFYQ

DSVRGRFTISTDNAKNTVYLQMNNLKPEDTAVYYCAANVGVTGSYEYWGQGTQVTVSS

>IL6RPMP107B4, SEQ ID NO: 189
EVQLVESGGGLVQAGGSLRLSCVASGLRLNMHRMGWFRQAPGKEREFVARIFTDDGDSYY

ADSVQGRFTISGDNAKNTVYLQMNSLKPEDTGVYFCAAGYMSGAESPIGYDNWGQGTQVTVSS

>IL6RPMP107C3, SEQ ID NO: 190
EVQLVESGGGLVQAGGSLNLSCNASGDIGSINAMGWHRQAPGQQREWVAVITDTDSTIYP

DSVKGRFAISRDGAKNTVHLRMSSLKPEDTAVYYCNAYQAGWGDYWGQGTQVTVSS

>IL6RPMP107E4, SEQ ID NO: 191
EVQLVESGGGLVQAGGSLRLSCAASGSIDRINAMGWYRQAPGKQRDFLAVITDGDKTLYA

DSVKGRFTISNDNAKNTVYLQMNSLKPEDTAVYYCNAYQAGWGDYWGQGTQVTVSS

>IL6RPMP107G10, SEQ ID NO: 192
EVQLVESGGGLVQAGGSLRLSCAASGSIENINAMGWYRQAPGKQRDFLAIITDGSKTLYA

DSVKGRFTISNDNAKNTVYLQMNSLKPEDTAVYYCNAYQAGWGDYWGQGTQVTVSS

>IL6RPMP107H2, SEQ ID NO: 193
KVQLVESGGGLVQPGGSLRLSCAASGFTFSSYAMSWVRRAPGKGLEWVSAINSDGTGSSY

APFVTGRFTASRDNAKNTLYLQMNSLKPEDTAVYYCTNSNRYDYADFSAVRGQGTQVTVSS

>IL6RPMP107H5, SEQ ID NO: 194
EVPLVESGGGLVQAGGSLNLSCNASGDIGSINAMGWYRQAPGQQREWVAVITDTDSTIYP

DSVKGRFAISRDGAKNTVHLRMSSLKPEDTAVYYCNAYQRGWGDYWGQGTQVTVSS

>IL6RPMP108C10, SEQ ID NO: 195
EVQLVESGGGLVQPGGSLRLSCTASGRTFSDYDMGWFRQAPGKERECVAVIDTNGDNTLT

VGSVKGRFAISRDNAKNTVYLQMNSLLPEDTAVYTCAAGAWSSLRSTAANYWGQGTQVTVSS

>IL6RPMP108C9, SEQ ID NO: 196
EVQLVESGGGLVQAGGSLRLSCAASGRTYAMAWFRQAPGKEREFVAAISIVTDYADSVKG

RFNISRDNRENTVYLQMNSLKPEDTAVYYCAANTYYSGAYFPRGHEWYEYWGQGTQVTVSS

>IL6RPMP108D1, SEQ ID NO: 197
EVQLVESGGGLVQAGGSLRLSCTASGRTFSDYDMGWFRQAPGKERECVAVIDTNGDNTLT

VGSVKGRFAISRDNAKNTVYLQMNSLLPEDTAVYTCAAGAWSSLRSTAANYWGQGTKVTVSS

>IL6RPMP108D10, SEQ ID NO: 198
EVQLVESGGGSVQAGGSLRLSCTASGRTFSDYDMGWFRQAPGKERECVAVIDTNGDNTLT

VGSVKGRFAISRDNAKNTVYLQMNSLLPEDTAVYTCAAGAWSSLRSTAANYWGQGTQVTVSS

TABLE A-3-continued

Protein sequences of monovalent anti-IL-6R Nanobodies

>IL6RPMP108D2, SEQ ID NO: 199
EVQLVESGGGLVQAGGSLRLSCAASGFTFDDYDIGWFRQAPGKEREGVSGISSSDGNTYY

ADSVKGRFTISSDNAKNTVYLQMNSLKPEDTAVYYCAAEPPDSSWYLDGSPEFFKYWGQGTQVTVSS

>IL6RPMP108E1, SEQ ID NO: 200
EVQLVESGGGLVQAGGSLRLSCAASGFTFDDYDIGWFRQAPGKEREGVSGISSSDGNTYY

ADSVKGRFTISSDNAKNTVYLQMNSLKPEDTAVYYCAAEPPDSSWYLDGSPEFFKYWGQGTQVTVSS

>IL6RPMP108E9, SEQ ID NO: 201
EVQLVESGGGLVQAGGSLRLSCAFSRRSFGNFPMGWFRQRPGEEREYVAVISWNNNYIHY

RDSVKGRFTASRDTSENRMYLQMNGLKPEDTAVYYCAARTKDNTLFTPAEEYDYWGQGTQVTVSS

>IL6RPMP108F7, SEQ ID NO: 202
EVQLVESGGGLVQAGGSLRLSCTASGRTFSDYDMGWFRQAPGKERECVAVIDTNGDNTLT

VGSVKGRFAISRDNAKNTVYLQMNSLLPEDTAVYTCAAGAWSSLRSTAANYWGQGTQVTVSS

>IL6RPMP119A10, SEQ ID NO: 203
EVQLVESGGGLVQPGGSLRLSCAASKSIFDINAMYWHRQAPGKQRESVASITSGGMRNYA

DSVKDRFTISKDNAKNTVYLQMNGLKPDDTAVYYCGLGRYEGGVWRDYWGQGTQVTVSS

>IL6RPMP120A1, SEQ ID NO: 204
EVQLVESGGGLVQAGGSLSLSCATSGRTISDDTMAWFRQAPGKEREFVATITFSGARTHY

SDSVRDRFTISRDNAKNTVYLQMNSLKSEDTAVYYCAASTKYYSSTYNYIHPAFYDIWGQGTQVTVSS

>IL6RPMP120A5, SEQ ID NO: 205
EVQLVESGGGLVQAGGSLSLSCATSGRTISDDTMAWFRQAPGKEREFVAIITFNGARTHY

SDSVRDRFTISRDNAKNTVYLQMNSLKSEDTAVYYCAASTKYYSSTYNYIHPAFYDIWGQGTQVTVSS

>IL6RPMP120B2, SEQ ID NO: 206
EVQLVESGGGLVQAGGSLSLSCATSGRTISDDTMAWFRQAPGKEREFVATITFSGARTHY

SDSVRDRFTISRDNAKNTVYLQMNSLKSEDTAVYYCAASTKYYSSTYNYIHPAFYDIWGQGTQVTVSS

>IL6RPMP120B7, SEQ ID NO: 207
EVQLVESGGGLVQAGGSLSLSCATSGRTISDDTMAWFRQAPGKEREFVATITFSGARTHY

SDSVRDRFTISRDNAKNTVYLQMNSLKSEDTAVYYCAASTKYYSSTYNYIHPAFYDIWGQGTQVTVSS

>IL6RPMP120C1, SEQ ID NO: 208
EVQLVESGGGLVQAGGSLSLSCATSGRTISDDTMAWFRQAPGKEREFVATITFSGARTHY

SDSVRDRFTISRDNAKNTVYLQMNSLKSEDTAVYYCAASTKYYSSTYNYIHPAFYDIWGQGTQVTVSS

>IL6RPMP120C10, SEQ ID NO: 209
EVQLVESGGGLVQAGGSLSLSCATSGRTISDDTMAWFRQAPGKEREFVAIITFNGARTHY

SDSVRDRFTISRDNAKNTVYLQMNSLKSEDTAVYYCAASTKYYSSTYNYIHPAFYDIWGQGTQVTVSS

>IL6RPMP120C11, SEQ ID NO: 210
EVQLVESGGGLVQAGGSLSLSCATSGRTISDDTMAWFRQAPGKEREFVATITFSGARTHY

SDSVRDRFTISRDNAKNTVYLQMNSLKSEDTAVYYCAASTKYYSSTYNYIHPAFYDIWGQGTQVTVSS

>IL6RPMP120C5, SEQ ID NO: 211
EVQLVESGGRSVQAGGSLRLSCAASGRTFRDYAMGWFRQAPGKEREFVAVISWSGAYTEY

ADSVKGRFTISRNNAANTGALQMNSLKLEDTAVYYCAATMVPRAMVVDEFEYWGQGTQVTVSS

>IL6RPMP120D2, SEQ ID NO: 212
EVQLVESGGGLVQAGGSLSLSCATSGRTISDDTMAWFRQAPGKEREFVATITFSGARTHY

SDSVRDRFTISRDNAKNTVYLQMNSLKSEDTAVYYCAASTKYYSSTYNYIHPAFYDIWGQGTQVTVSS

>IL6RPMP120F4, SEQ ID NO: 213
EVQLVESGGGLVQTGGSLRLSCAVSGRTDSTASVGWFRQAPGKQREWVVGISSGGSTHYA

DSVKGRFISSQDDAKNTVYLQMNSLKPEDTAIYYCAIAHGSSTYNYWGQGTQVTVSS

>IL6RPMP120G11, SEQ ID NO: 214
EVQLVESGGGLVQAGGSVRLSCTASGGTLSGNAMGWFRQAPGTEREFVAAITWSGDMSVY

TABLE A-3-continued

Protein sequences of monovalent anti-IL-6R Nanobodies

AEFVKGRFTVSRDNAKSVVYLQMNRLKPEDTSVYYCAGDIRGRENFGSWGQGTQVTVSS

>IL6RPMP120G6, SEQ ID NO: 215
EVQLVESGGDLVQTGGSLRLSCAASGITVSDRAMGWYRQAPGKQREMVAGVSRGGMTSYA

DSVKGRLTISRDNAKNSVYLQMNSLNPEDTAVYYCSAYYRGSSVPQYWGQGTQVTVSS

>IL6RPMP120H6, SEQ ID NO: 216
EVQLVESGGGLVQPGGSLRLSCVVSGIIFSDNAMGWYRQYPGKQREWVAGISRGGTTGYT

DSVKGRFTISRDNAKNTVYLQMNSLKPEDTAVYYCAIPTENQPDHWGQGTQVTVSS

TABLE A-4

Protein sequences of biparatopic anti-IL-6R Nanobodies
(IL6R-IL6 inhibiting block combined with a non-inhibiting,
hybrid IL6R binding block)

IL6R120A5-GS9-IL6R101H6, SEQ ID NO: 812
EVQLVESGGGLVQAGGSLSLSCATSGRTISDDTMAWFRQAPGKEREFVAIITFNGARTHYSDS

VRDRFTISRDNAKNTVYLQMNSLKSEDTAVYYCAASTKYYSSTYNYIHPAFYDIWGQGTQVTV

SSGGGGSGGGSEVQLVESGGGLVQAGGSLRLSCTASGRTFTDYDMGWFRQAPGKEREVVAIID

TNGDNTLTVGSVKGRFAISSDNAKNTVYLQMNSLLPEDTAVYTCAAGAWSALRRSVANYWGQG

TQVTVSS

IL6R120A5-GS9-IL6R104E4, SEQ ID NO: 813
EVQLVESGGGLVQAGGSLSLSCATSGRTISDDTMAWFRQAPGKEREFVAIITFNGARTHYSDS

VRDRFTISRDNAKNTVYLQMNSLKSEDTAVYYCAASTKYYSSTYNYIHPAFYDIWGQGTQVTV

SSGGGGSGGGSEVQLVESGGGTVQAGGSLKLSCAASGRTFTNYAMGWFRQAPGKEREFVAAIA

YATHFADSVKGRFTISRGNAKNTVYLQMNSLKPEDTAVYYCAADLSLSKMVSKITSDMDYWGK

GTLVTVSS

IL6R120A5-GS9-IL6R103A4, SEQ ID NO: 814
EVQLVESGGGLVQAGGSLSLSCATSGRTISDDTMAWFRQAPGKEREFVAIITFNGARTHYSDS

VRDRFTISRDNAKNTVYLQMNSLKSEDTAVYYCAASTKYYSSTYNYIHPAFYDIWGQGTQVTV

SSGGGGSGGGSEVQLVESGGGLVQPGGSLRLSCAASGSIFSINTMGWYRQVPGKQRELVATVR

SGSITNYADSVQDRFTITRDIDENTVYLQMNSLKPEDTAVYYCLTRASVPGRGYQDYWGQGTQ

VTVSS

IL6R120G6-GS9-IL6R101H6, SEQ ID NO: 815
EVQLVESGGDLVQTGGSLRLSCAASGITVSDRAMGWYRQAPGKQREMVAGVSRGGMTSYADSV

KGRLTISRDNAKNSVYLQMNSLNPEDTAVYYCSAYYRGSSVPQYWGQGTQVTVSSGGGGSGG

GSEVQLVESGGGLVQAGGSLRLSCTASGRTFTDYDMGWFRQAPGKEREVVAIIDTNGDNTLTV

GSVKGRFAISSDNAKNTVYLQMNSLLPEDTAVYTCAAGAWSALRRSVANYWGQGTQVTVSS

IL6R120G6-GS9-IL6R104E4, SEQ ID NO: 816
EVQLVESGGDLVQTGGSLRLSCAASGITVSDRAMGWYRQAPGKQREMVAGVSRGGMTSYADSV

KGRLTISRDNAKNSVYLQMNSLNPEDTAVYYCSAYYRGSSVPQYWGQGTQVTVSSGGGGSGG

GSEVQLVESGGGTVQAGGSLKLSCAASGRTFTNYAMGWFRQAPGKEREFVAAIAYATHFADSV

KGRFTISRGNAKNTVYLQMNSLKPEDTAVYYCAADLSLSKMVSKITSDMDYWGKGTLVTVSS

IL6R120G6-GS9-IL6R103A4, SEQ ID NO: 817
EVQLVESGGDLVQTGGSLRLSCAASGITVSDRAMGWYRQAPGKQREMVAGVSRGGMTSYADSV

KGRLTISRDNAKNSVYLQMNSLNPEDTAVYYCSAYYRGSSVPQYWGQGTQVTVSSGGGGSGG

TABLE A-4-continued

Protein sequences of biparatopic anti-IL-6R Nanobodies
(IL6R-IL6 inhibiting block combined with a non-inhibiting,
hybrid IL6R binding block)

GSEVQLVESGGGLVQPGGSLRLSCAASGSIFSINTMGWYRQVPGKQRELVATVRSGSITNYAD

SVQDRFTITRDIDENTVYLQMNSLKPEDTAVYYCLTRASVPGRGYQDYWGQGTQVTVSS

IL6R105E1-GS9-IL6R101H6, SEQ ID NO: 818
EVQLVESGGGLVQAGGSLRLSCAASGSIFSIKAMGWYRQAPGKQRELVARITSGGSTYYADSV

KGRFTISRDNAKNTVYLQMNSLKPEDTAVFYCNAIVTDSDYDLGNDYWGQGTQVTVSSGGGGS

GGGSEVQLVESGGGLVQAGGSLRLSCTASGRTFTDYDMGWFRQAPGKEREVVAIIDTNGDNTL

TVGSVKGRFAISSDNAKNTVYLQMNSLLPEDTAVYTCAAGAWSALRRSVANYWGQGTQVTVSS

IL6R105E1-GS9-IL6R104E4, SEQ ID NO: 819
EVQLVESGGGLVQAGGSLRLSCAASGSIFSIKAMGWYRQAPGKQRELVARITSGGSTYYADSV

KGRFTISRDNAKNTVYLQMNSLKPEDTAVFYCNAIVTDSDYDLGNDYWGQGTQVTVSSGGGGS

GGGSEVQLVESGGGTVQAGGSLKLSCAASGRTFTNYAMGWFRQAPGKEREFVAAIAYATHFAD

SVKGRFTISRGNAKNTVYLQMNSLKPEDTAVYYCAADLSLSKMVSKITSDMDYWGKGTLVTVS

S

IL6R105E1-GS9-IL6R103A4, SEQ ID NO: 820
EVQLVESGGGLVQAGGSLRLSCAASGSIFSIKAMGWYRQAPGKQRELVARITSGGSTYYADSV

KGRFTISRDNAKNTVYLQMNSLKPEDTAVFYCNAIVTDSDYDLGNDYWGQGTQVTVSSGGGGS

GGGSEVQLVESGGGLVQPGGSLRLSCAASGSIFSINTMGWYRQVPGKQRELVATVRSGSITNY

ADSVQDRFTITRDIDENTVYLQMNSLKPEDTAVYYCLTRASVPGRGYQDYWGQGTQVTVSS

IL6R103C4-GS9-IL6R101H6, SEQ ID NO: 821
EVQLVESGGGLVEAGGSLRLSCAAAGRTLSSYSMAWFRQAPGKEREFVAIIRGNPSRTYHSDS

VKGRFTASRDNAKNTVYLQMNRLEPEDTAVYYCAADPPPFASDYSAPQSYDYWGQGTQVTVSS

GGGGSGGGSEVQLVESGGGLVQAGGSLRLSCTASGRTFTDYDMGWFRQAPGKEREVVAIIDTN

GDNTLTVGSVKGRFAISSDNAKNTVYLQMNSLLPEDTAVYTCAAGAWSALRRSVANYWGQGTQ

VTVSS

IL6R103C4-GS9-IL6R104E4, SEQ ID NO: 822
EVQLVESGGGLVEAGGSLRLSCAAAGRTLSSYSMAWFRQAPGKEREFVAIIRGNPSRTYHSDS

VKGRFTASRDNAKNTVYLQMNRLEPEDTAVYYCAADPPPFASDYSAPQSYDYWGQGTQVTVSS

GGGGSGGGSEVQLVESGGGTVQAGGSLKLSCAASGRTFTNYAMGWFRQAPGKEREFVAAIAYA

THFADSVKGRFTISRGNAKNTVYLQMNSLKPEDTAVYYCAADLSLSKMVSKITSDMDYWGKGT

LVTVSS

IL6R103H9-GS9-IL6R101H6, SEQ ID NO: 823
EVQLVESGGGLVQPGGSLRLSCAASKSIFDINAMYWHRQAPGKQRESVASITSGGMRNYADSV

KDRFTISKDNAKNTVYLQMNGLKPDDTAVYYCGLGRYEGGVWRDYWGQGTQVTVSSGGGGSGG

GSEVQLVESGGGLVQAGGSLRLSCTASGRTFTDYDMGWFRQAPGKEREVVAIIDTNGDNTLTV

GSVKGRFAISSDNAKNTVYLQMNSLLPEDTAVYTCAAGAWSALRRSVANYWGQGTQVTVSS

IL6R103H9-GS9-IL6R104E4, SEQ ID NO: 824
EVQLVESGGGLVQPGGSLRLSCAASKSIFDINAMYWHRQAPGKQRESVASITSGGMRNYADSV

KDRFTISKDNAKNTVYLQMNGLKPDDTAVYYCGLGRYEGGVWRDYWGQGTQVTVSSGGGGSGG

GSEVQLVESGGGTVQAGGSLKLSCAASGRTFTNYAMGWFRQAPGKEREFVAAIAYATHFADSV

KGRFTISRGNAKNTVYLQMNSLKPEDTAVYYCAADLSLSKMVSKITSDMDYWGKGTLVTVSS

IL6R103H9-GS9-IL6R103A4, SEQ ID NO: 825
EVQLVESGGGLVQPGGSLRLSCAASKSIFDINAMYWHRQAPGKQRESVASITSGGMRNYADSV

TABLE A-4-continued

Protein sequences of biparatopic anti-IL-6R Nanobodies
(IL6R-IL6 inhibiting block combined with a non-inhibiting,
hybrid IL6R binding block)

KDRFTISKDNAKNTVYLQMNGLKPDDTAVYYCGLGRYEGGVWRDYWGQGTQVTVSSGGGGSGG

GSEVQLVESGGGLVQPGGSLRLSCAASGSIFSINTMGWYRQVPGKQRELVATVRSGSITNYAD

SVQDRFTITRDIDENTVYLQMNSLKPEDTAVYYCLTRASVPGRGYQDYWGQGTQVTVSS

IL6R107A1-GS9-IL6R101H6, SEQ ID NO: 826
EVQLVESGGGLVQAGGSLNLSCNASGDIGSINAMGWYRQAPGQQREWVAVITDTDSTIYPDSV

KGRFAISRDGAKNTVHLRMSSLKPEDTAVYYCNAYQAGWGDYWGQGTQVTVSSGGGGSGGGSE

VQLVESGGGLVQAGGSLRLSCTASGRTFTDYDMGWFRQAPGKEREVVAIIDTNGDNTLTVGSV

KGRFAISSDNAKNTVYLQMNSLLPEDTAVYTCAAGAWSALRRSVANYWGQGTQVTVSS

IL6R107A1-GS9-IL6R104E4, SEQ ID NO: 827
EVQLVESGGGLVQAGGSLNLSCNASGDIGSINAMGWYRQAPGQQREWVAVITDTDSTIYPDSV

KGRFAISRDGAKNTVHLRMSSLKPEDTAVYYCNAYQAGWGDYWGQGTQVTVSSGGGGSGGGSE

VQLVESGGGTVQAGGSLKLSCAASGRTFTNYAMGWFRQAPGKEREFVAAIAYATHFADSVKGR

FTISRGNAKNTVYLQMNSLKPEDTAVYYCAADLSLSKMVSKITSDMDYWGKGTLVTVSS

IL6R107A1-GS9-IL6R103A4, SEQ ID NO: 828
EVQLVESGGGLVQAGGSLNLSCNASGDIGSINAMGWYRQAPGQQREWVAVITDTDSTIYPDSV

KGRFAISRDGAKNTVHLRMSSLKPEDTAVYYCNAYQAGWGDYWGQGTQVTVSSGGGGSGGGSE

VQLVESGGGLVQPGGSLRLSCAASGSIFSINTMGWYRQVPGKQRELVATVRSGSITNYADSVQ

DRFTITRDIDENTVYLQMNSLKPEDTAVYYCLTRASVPGRGYQDYWGQGTQVTVSS

IL6R107A9-GS9-IL6R101H6, SEQ ID NO: 829
EVQLVESGGGLVQAGGSLRLSCAASGGIFSDMFMGWFRQAPGKSRESVARISPSGNTFYQDSV

RGRFTISTDNAKNTVYLQMNNLKPEDTAVYYCAANVGTGSYEYWGQGTQVTVSSGGGGSGGG

SEVQLVESGGGLVQAGGSLRLSCTASGRTFTDYDMGWFRQAPGKEREVVAIIDTNGDNTLTVG

SVKGRFAISSDNAKNTVYLQMNSLLPEDTAVYTCAAGAWSALRRSVANYWGQGTQVTVSS

IL6R107A9-GS9-IL6R104E4, SEQ ID NO: 830
EVQLVESGGGLVQAGGSLRLSCAASGGIFSDMFMGWFRQAPGKSRESVARISPSGNTFYQDSV

RGRFTISTDNAKNTVYLQMNNLKPEDTAVYYCAANVGTGSYEYWGQGTQVTVSSGGGGSGGG

SEVQLVESGGGTVQAGGSLKLSCAASGRTFTNYAMGWFRQAPGKEREFVAAIAYATHFADSVK

GRFTISRGNAKNTVYLQMNSLKPEDTAVYYCAADLSLSKMVSKITSDMDYWGKGTLVTVSS

IL6R107A9-GS9-IL6R103A4, SEQ ID NO: 831
EVQLVESGGGLVQAGGSLRLSCAASGGIFSDMFMGWFRQAPGKSRESVARISPSGNTFYQDSV

RGRFTISTDNAKNTVYLQMNNLKPEDTAVYYCAANVGTGSYEYWGQGTQVTVSSGGGGSGGG

SEVQLVESGGGLVQPGGSLRLSCAASGSIFSINTMGWYRQVPGKQRELVATVRSGSITNYADS

VQDRFTITRDIDENTVYLQMNSLKPEDTAVYYCLTRASVPGRGYQDYWGQGTQVTVSS

IL6R120A5-GS9-IL6R101H6, SEQ ID NO: 832
EVQLVESGGGLVQAGGSLSLSCATSGRTISDDTMAWFRQAPGKEREFVAIITFNGARTHYSDS

VRDRFTISRDNAKNTVYLQMNSLKSEDTAVYYCAASTKYYSSTYNYIHPAFYDIWGQGTQVTV

SSGGGGSGGGSEVQLVESGGGLVQAGGSLRLSCTASGRTFTDYDMGWFRQAPGKEREVVAIID

TNGDNTLTVGSVKGRFAISSDNAKNTVYLQMNSLLPEDTAVYTCAAGAWSALRRSVANYWGQG

TQVTVSS

IL6R120A5-GS35-IL6R104E4, SEQ ID NO: 833
EVQLVESGGGLVQAGGSLSLSCATSGRTISDDTMAWFRQAPGKEREFVAIITFNGARTHYSDS

VRDRFTISRDNAKNTVYLQMNSLKSEDTAVYYCAASTKYYSSTYNYIHPAFYDIWGQGTQVIV

TABLE A-4-continued

Protein sequences of biparatopic anti-IL-6R Nanobodies
(IL6R-IL6 inhibiting block combined with a non-inhibiting,
hybrid IL6R binding block)

SSGGGGSGGGGSGGGGSGGGGSGGGGSGGGGSGGGGSEVQLVESGGGTVQAGGSLKLSCAASG

RTFTNYAMGWFRQAPGKEREFVAAIAYATHFADSVKGRFTISRGNAKNTVYLQMNSLKPEDTA

VYYCAADLSLSKMVSKITSDMDYWGKGTLVTVSS

IL6R120A5-GS35-IL6R103A4, SEQ ID NO: 834
EVQLVESGGGLVQAGGSLSLSCATSGRTISDDTMAWFRQAPGKEREFVAIITFNGARTHYSDS

VRDRFTISRDNAKNTVYLQMNSLKSEDTAVYYCAASTKYYSSTYNYIHPAFYDIWGQGTQVTV

SSGGGGSGGGGSGGGGSGGGGSGGGGSGGGGSGGGGSEVQLVESGGGLVQPGGSLRLSCAASG

SIFSINTMGWYRQVPGKQRELVATVRSGSITNYADSVQDRFTITRDIDENTVYLQMNSLKPED

TAVYYCLTRASVPGRGYQDYWGQGTQVTVSS

IL6R120G6-GS35-IL6R101H6, SEQ ID NO: 835
EVQLVESGGDLVQTGGSLRLSCAASGITVSDRAMGWYRQAPGKQREMVAGVSRGGMTSYADSV

KGRLTISRDNAKNSVYLQMNSLNPEDTAVYYCSAYYRYGSSVPQYWGQGTQVTVSSGGGGSGG

GGSGGGGSGGGGSGGGGSGGGGSGGGGSEVQLVESGGGLVQAGGSLRLSCTASGRTFTDYDMG

WFRQAPGKEREVVAIIDTNGDNTLTVGSVKGRFAISSDNAKNTVYLQMNSLLPEDTAVYTCAA

GAWSALRRSVANYWGQGTQVTVSS

IL6R120G6-GS35-IL6R104E4, SEQ ID NO: 836
EVQLVESGGDLVQTGGSLRLSCAASGITVSDRAMGWYRQAPGKQREMVAGVSRGGMTSYADSV

KGRLTISRDNAKNSVYLQMNSLNPEDTAVYYCSAYYRYGSSVPQYWGQGTQVTVSSGGGGSGG

GGSGGGGSGGGGSGGGGSGGGGSGGGGSEVQLVESGGGLVQAGGSLKLSCAASGRTFTNYAMG

WFRQAPGKEREFVAAIAYATHFADSVKGRFTISRGNAKNTVYLQMNSLKPEDTAVYYCAADLS

LSKMVSKITSDMDYWGKGTLVTVSS

IL6R120G6-GS35-IL6R103A4, SEQ ID NO: 837
EVQLVESGGDLVQTGGSLRLSCAASGITVSDRAMGWYRQAPGKQREMVAGVSRGGMTSYADSV

KGRLTISRDNAKNSVYLQMNSLNPEDTAVYYCSAYYRYGSSVPQYWGQGTQVTVSSGGGGSGG

GGSGGGGSGGGGSGGGGSGGGGSGGGGSEVQLVESGGGLVQPGGSLRLSCAASGSIFSINTMG

WYRQVPGKQRELVATVRSGSITNYADSVQDRFTITRDIDENTVYLQMNSLKPEDTAVYYCLTR

ASVPGRGYQDYWGQGTQVTVSS

IL6R105E1-GS35-IL6R101H6, SEQ ID NO: 838
EVQLVESGGGLVQAGGSLRLSCAASGSIFSIKAMGWYRQAPGKQRELVARITSGGSTYYADSV

KGRFTISRDNAKNTVYLQMNSLKPEDTAVFYCNAIVTDSDYDLGNDYWGQGTQVTVSSGGGGS

GGGGSGGGGSGGGGSGGGGSGGGGSGGGGSEVQLVESGGGLVQAGGSLRLSCTASGRTFTDYD

MGWFRQAPGKEREVVAIIDTNGDNTLTVGSVKGRFAISSDNAKNTVYLQMNSLLPEDTAVYTC

AAGAWSALRRSVANYWGQGTQVTVSS

IL6R105E1-GS35-IL6R104E4, SEQ ID NO: 839
EVQLVESGGGLVQAGGSLRLSCAASGSIFSIKAMGWYRQAPGKQRELVARITSGGSTYYADSV

KGRFTISRDNAKNTVYLQMNSLKPEDTAVFYCNAIVTDSDYDLGNDYWGQGTQVTVSSGGGGS

GGGGSGGGGSGGGGSGGGGSGGGGSGGGGSEVQLVESGGGTVQAGGSLKLSCAASGRTFTNYA

MGWFRQAPGKEREFVAAIAYATHFADSVKGRFTISRGNAKNTVYLQMNSLKPEDTAVYYGAAD

LSLSKMVSKITSDMDYWGKGTLVTVSS

IL6R105E1-GS35-IL6R103A4, SEQ ID NO: 840
EVQLVESGGGLVQAGGSLRLSCAASGSIFSIKAMGWYRQAPGKQRELVARITSGGSTYYADSV

KGRFTISRDNAKNTVYLQMNSLKPEDTAVFYCNAIVTDSDYDLGNDYWGQGTQVTVSSGGGGS

TABLE A-4-continued

Protein sequences of biparatopic anti-IL-6R Nanobodies
(IL6R-IL6 inhibiting block combined with a non-inhibiting,
hybrid IL6R binding block)

GGGGSGGGGSGGGGSGGGGSGGGGSGGGGSEVQLVESGGGLVQPGGSLRLSCAASGSIFSINT

MGWYRQVPGKQRELVATVRSGSITNYADSVQDRFTITRDIDENTVYLQMNSLKPEDTAVYYCL

TRASVPGRGYQDYWGQGTQVTVSS

IL6R103C4-GS35-IL6R101H6, SEQ ID NO: 841
EVQLVESGGGLVEAGGSLRLSCAAAGRTLSSYSMAWFRQAPGKEREFVAIIRGNPSRTYHSDS

VKGRFTASRDNAKNTVYLQMNRLEPEDTAVYYCAADPPPFASDYSAPQSYDYWGQGTQVTVSS

GGGGSGGGGSGGGGSGGGGSGGGGSGGGGSGGGGSEVQLVESGGGLVQAGGSLRLSCTASGRT

FTDYDMGWFRQAPGKEREVVAIIDTNGDNTLTVGSVKGRFAISSDNAKNTVYLQMNSLLPEDT

AVYTCAAGAWSALRRSVANYWGQGTQVTVSS

IL6R103C4-GS35-IL6R104E4, SEQ ID NO: 842
EVQLVESGGGLVEAGGSLRLSCAAAGRTLSSYSMAWFRQAPGKEREFVAIIRGNPSRTYHSDS

VKGRFTASRDNAKNTVYLQMNRLEPEDTAVYYCAADPPPFASDYSAPQSYDYWGQGTQVTVSS

GGGGSGGGGSGGGGSGGGGSGGGGSGGGGSGGGGSEVQLVESGGGTVQAGGSLKLSCAASGRT

FTNYAMGWFRQAPGKEREFVAAIAYATHFADSVKGRFTISRGNAKNTVYLQMNSLKPEDTAVY

YCAADLSLSKMVSKITSDMDYWGKGTLVTVSS

IL6R103H9-GS35-IL6R101H6, SEQ ID NO: 843
EVQLVESGGGLVQPGGSLRLSCAASKSIFDINAMYWHRQAPGKQRESVASITSGGMRNYADSV

KDRFTISKDNAKNTVYLQMNGLKPDDTAVYYCGLGRYEGGVWRDYWGQGTQVTVSSGGGGSGG

GGSGGGGSGGGGSGGGGSGGGGSGGGGSEVQLVESGGGLVQAGGSLRLSCTASGRTFTDYDMG

WFRQAPGKEREVVAIIDTNGDNTLTVGSVKGRFAISSDNAKNTVYLQMNSLLPEDTAVYTCAA

GAWSALRRSVANYWGQGTQVTVSS

IL6R103H9-GS35-IL6R104E4, SEQ ID NO: 844
EVQLVESGGGLVQPGGSLRLSCAASKSIFDINAMYWHRQAPGKQRESVASITSGGMRNYADSV

KDRFTISKDNAKNTVYLQMNGLKPDDTAVYYCGLGRYEGGVWRDYWGQGTQVTVSSGGGGSGG

GGSGGGGSGGGGSGGGGSGGGGSGGGGSEVQLVESGGGTVQAGGSLKLSCAASGRTFTNYAMG

WFRQAPGKEREFVAAIAYATHFADSVKGRFTISRGNAKNTVYLQMNSLKPEDTAVYYCAADLS

LSKMVSKITSDMDYWGKGTLVTVSS

IL6R103H9-GS35-IL6R103A4, SEQ ID NO: 845
EVQLVESGGGLVQPGGSLRLSCAASKSIFDINAMYWHRQAPGKQRESVASITSGGMRNYADSV

KDRFTISKDNAKNTVYLQMNGLKPDDTAVYYCGLGRYEGGVWRDYWGQGTQVTVSSGGGGSGG

GGSGGGGSGGGGSGGGGSGGGGSGGGGSEVQLVESGGGLVQPGGSLRLSCAASGSIFSINTMG

WYRQVPGKQRELVATVRSGSITNYADSVQDRFTITRDIDENTVYLQMNSLKPEDTAVYYCLTR

ASVPGRGYQDYWGQGTQVTVSS

IL6R107A1-GS35-IL6R101H6, SEQ ID NO: 846
EVQLVESGGGLVQAGGSLNLSCNASGDIGSINAMGWYRQAPGQQREWVAVITDTDSTIYPDSV

KGRFAISRDGAKNTVHLRMSSLKPEDTAVYYCNAYQAGWGDYWGQGTQVTVSSGGGGSGGGGS

GGGGSGGGGSGGGGSGGGGSEVQLVESGGGLVQAGGSLRLSCTASGRTFTDYDMGWFR

QAPGKEREVVAIIDTNGDNTLTVGSVKGRFAISSDNAKNTVYLQMNSLLPEDTAVYTCAAGAW

SALRRSVANYWGQGTQVTVSS

IL6R107A1-GS35-IL6R104E4, SEQ ID NO: 847
EVQLVESGGGLVQAGGSLNLSCNASGDIGSINAMGWYRQAPGQQREWVAVITDTDSTIYPDSV

TABLE A-4-continued

Protein sequences of biparatopic anti-IL-6R Nanobodies
(IL6R-IL6 inhibiting block combined with a non-inhibiting,
hybrid IL6R binding block)

KGRFAISRDGAKNTVHLRMSSLKPEDTAVYYCNAYQAGWGDYWGQGTQVTVSSGGGGSGGGGS

GGGGSGGGGSGGGGSGGGGSGGGGSEVQLVESGGGTVQAGGSLKLSCAASGRTFTNYAMGWFR

QAPGKEREFVAAIAYATHFADSVKGRFTISRGNAKNTVYLQMNSLKPEDTAVYYCAADLSLSK

MVSKITSDMDYWGKGTLVTVSS

IL6R107A1-GS35-IL6R103A4, SEQ ID NO: 848
EVQLVESGGGLVQAGGSLNLSCNASGDIGSINAMGWYRQAPGQQREWVAVITDTDSTIYPDSV

KGRFAISRDGAKNTVHLRMSSLKPEDTAVYYCNAYQAGWGDYWGQGTQVTVSSGGGGSGGGGS

GGGGSGGGGSGGGGSGGGGSGGGGSEVQLVESGGGLVQPGGSLRLSCAASGSIFSINTMGWYR

QVPGKQRELVATVRSGSITNYADSVQDRETITRDIDENTVYLQMNSLKPEDTAVYYCLTRASV

PGRGYQDYWGQGTQVTVSS

IL6R107A9-GS35-IL6R101H6, SEQ ID NO: 849
EVQLVESGGGLVQAGGSLRLSCAASGGIFSDMFMGWFRQAPGKSRESVARISPSGNTFYQDSV

RGRFTISTDNAKNTVYLQMNNLKPEDTAVYYCAANVGVTGSYEYWGQGTQVTVSSGGGGSGGG

GSGGGGSGGGGSGGGGSGGGGSGGGGSEVQLVESGGGLVQAGGSLRLSCTASGRTFTDYDMGW

FRQAPGKEREVVAIIDTNGDNTLTVGSVKGRFAISSDNAKNTVYLQMNSLLPEDTAVYTCAAG

AWSALRRSVANYWGQGTQVTVSS

IL6R107A9-GS35-IL6R104E4, SEQ ID NO: 850
EVQLVESGGGLVQAGGSLRLSCAASGGIFSDMFMGWFRQAPGKSRESVARISPSGNTFYQDSV

RGRFTISTDNAKNTVYLQMNNLKPEDTAVYYCAANVGVTGSYEYWGQGTQVTVSSGGGGSGGG

GSGGGGSGGGGSGGGGSGGGGSGGGGSEVQLVESGGGTVQAGGSLKLSCAASGRTFTNYAMGW

FRQAPGKEREFVAAIAYATHFADSVKGRFTISRGNAKNTVYLQMNSLKPEDTAVYYCAADLSL

SKMVSKITSDMDYWGKGTLVTVSS

IL6R107A9-GS35-IL6R103A4, SEQ ID NO: 851
EVQLVESGGGLVQAGGSLRLSCAASGGIFSDMFMGWFRQAPGKSRESVARISPSGNTFYQDSV

RGRFTISTDNAKNTVYLQMNNLKPEDTAVYYCAANVGVTGSYEYWGQGTQVTVSSGGGGSGGG

GSGGGGSGGGGSGGGGSGGGGSGGGGSEVQLVESGGGLVQPGGSLRLSCAASGSIFSINTMGW

YRQVPGKQRELVATVRSGSITNYADSVQDRFTITRDIDENTVYLQMNSLKPEDTAVYYCLTRA

SVPGRGYQDYWGQGTQVTVSS

IL6R101H6-GS35-IL6R105E1, SEQ ID NO: 946
EVQLVESGGGLVQAGGSLRLSCTASGRTFTDYDMGWFRQAPGKEREVVAIIDTNGDNTLTVGS

VKGRFAISSDNAKNTVYLQMNSLLPEDTAVYTCAAGAWSALRRSVANYWGQGTQVTVSSGGGG

SGGGGSGGGGSGGGGSGGGGSGGGGSGGGGSEVQLVESGGGLVQAGGSLRLSCAASGSIFSIK

AMGWYRQAPGKQRELVARITSGGSTYYADSVKGRFTISRDNAKNTVYLQMNSLKPEDTAVFYC

NAIVTDSDYDLGNDYWGQGTQVTVSS

TABLE A-5

Protein sequences of biparatopic anti-IL-6R Nanobodies
(IL6R-IL6 inhibiting block combined with a non-inhibiting,
IL6R binding block but not hybrid IL6R binding block)

IL6R120A5-GS9-IL6R100D11, SEQ ID NO: 852
EVQLVESGGGLVQAGGSLSLSCATSGRTISDDTMAWFRQAPGKEREFVAIITFNGART

HYSDSVRDRFTISRDNAKNTVYLQMNSLKSEDTAVYYCAASTKYYSSTYNYIHPAFYD

TABLE A-5-continued

Protein sequences of biparatopic anti-IL-6R Nanobodies
(IL6R-IL6 inhibiting block combined with a non-inhibiting,
IL6R binding block but not hybrid IL6R binding block)

IWGQGTQVTVSSGGGGSGGGSEVQLVESGGGLVQAGDSLRLSCLASGRSFKDDAMGWF

RQAPGKEREFVSGIDWRGNIVDAESVKGRFTISRENAKNTLYLQMNHLKPEDTAVYYC

AASSVFSDLRYRKNPKYWGQGTQVTVSS

IL6R120A5-GS9-IL6R101B12, SEQ ID NO: 853
EVQLVESGGGLVQAGGSLSLSCATSGRTISDDTMAWFRQAPGKEREFVAIITFNGART

HYSDSVRDRFTISRDNAKNTVYLQMNSLKSEDTAVYYCAASTKYYSSTYNYIHPAFYD

IWGQGTQVTVSSGGGGSGGGSEVQLVESGGGLVQPGGSLRLSCAASGVTLDYYAIGWF

RQAPGKEREGVSSISSNDGSTFYADSVKGRFTISRDKAKNTVYLQMNSLKPEDTAVYY

CAATYLTAQAVGVPVAYYEFDYWGQGTQVTVSS

IL6R120A5-GS9-IL6R107H2, SEQ ID NO: 854
EVQLVESGGGLVQAGGSLSLSCATSGRTISDDTMAWFRQAPGKEREFVAIITFNGART

HYSDSVRDRFTISRDNAKNTVYLQMNSLKSEDTAVYYCAASTKYYSSTYNYIHPAFYD

IWGQGTQVTVSSGGGGSGGGSKVQLVESGGGLVQPGGSLRLSCAASGFTFSSYAMSWV

RRAPGKGLEWVSAINSDGTGSSYAPFVTGRFTASRDNAKNTLYLQMNSLKPEDTAVYY

CTNSNRYDYADFSAVRGQGTQVTVSS

IL6R120A5-GS9-IL6R103A5, SEQ ID NO: 855
EVQLVESGGGLVQAGGSLSLSCATSGRTISDDTMAWFRQAPGKEREFVAIITFNGART

HYSDSVRDRFTISRDNAKNTVYLQMNSLKSEDTAVYYCAASTKYYSSTYNYIHPAFYD

IWGQGTQVTVSSGGGGSGGGSEVQLVESGGGLVQAGDSLRLSCVASGLPFSTLHMGWF

RQAPGKEHESVSAISSDGGSEYYAGSVKGRFTISRDNAKNTVYLQMNSLKPEDTAVYY

CAADPRRIGANIKYSDYWGQGTQVTVSS

IL6R120A5-GS9-IL6R103E2, SEQ ID NO: 856
EVQLVESGGGLVQAGGSLSLSCATSGRTISDDTMAWFRQAPGKEREFVAIITFNGART

HYSDSVRDRFTISRDNAKNTVYLQMNSLKSEDTAVYYCAASTKYYSSTYNYIHPAFYD

IWGQGTQVTVSSGGGGSGGGSEVQLVESGGGLVQPGGSLRLSCAASGSTFSINMMAWY

CQAPGKQRELVASISSGGGINYADSVKGRFTISRDYAENSVDLQMNSLKPEDTAVYYC

NARGTYLNGDHYSTNYNSWGQGTQVTVSS

IL6R120G6-GS9-IL6R100D11, SEQ ID NO: 857
EVQLVESGGDLVQTGGSLRLSCAASGITVSDRAMGWYRQAPGKQREMVAGVSRGGMTS

YADSVKGRLTISRDNAKNSVYLQMNSLNPEDTAVYYCSAYYRYGSSVPQYWGQGTQVT

VSSGGGGSGGGSEVQLVESGGGLVQAGDSLRLSCLASGRSFKDDAMGWFRQAPGKERE

FVSGIDWRGNIVDAESVKGRFTISRENAKNTLYLQMNHLKPEDTAVYYCAASSVFSDL

RYRKNPKYWGQGTQVTVSS

IL6R120G6-GS9-IL6R101B12, SEQ ID NO: 858
EVQLVESGGDLVQTGGSLRLSCAASGITVSDRAMGWYRQAPGKQREMVAGVSRGGMTS

YADSVKGRLTISRDNAKNSVYLQMNSLNPEDTAVYYCSAYYRYGSSVPQYWGQGTQVT

VSSGGGGSGGGSEVQLVESGGGLVQPGGSLRLSCAASGVTLDYYAIGWFRQAPGKERE

GVSSISSNDGSTFYADSVKGRFTISRDKAKNTVYLQMNSLKPEDTAVYYCAATYLTAQ

AVGVPVAYYEFDYWGQGTQVTVSS

IL6R120G6-GS9-IL6R107H2, SEQ ID NO: 859
EVQLVESGGDLVQTGGSLRLSCAASGITVSDRAMGWYRQAPGKQREMVAGVSRGGMTS

TABLE A-5-continued

Protein sequences of biparatopic anti-IL-6R Nanobodies
(IL6R-IL6 inhibiting block combined with a non-inhibiting,
IL6R binding block but not hybrid IL6R binding block)

YADSVKGRLTISRDNAKNSVYLQMNSLNPEDTAVYYCSAYYRGSSVPQYWGQGTQVT

VSSGGGGSGGGSKVQLVESGGGLVQPGGSLRLSCAASGFTFSSYAMSWVRRAPGKGLE

WVSAINSDGTGSSYAPFVTGRFTASRDNAKNTLYLQMNSLKPEDTAVYYCTNSNRYDY

ADFSAVRGQGTQVTVSS

IL6R120G6-GS9-IL6R103A5, SEQ ID NO: 860
EVQLVESGGDLVQTGGSLRLSCAASGITVSDRAMGWYRQAPGKQREMVAGVSRGGMTS

YADSVKGRLTISRDNAKNSVYLQMNSLNPEDTAVYYCSAYYRGSSVPQYWGQGTQVT

VSSGGGGSGGGSEVQLVESGGGLVQAGDSLRLSCVASGLPFSTLHMGWFRQAPGKEHE

SVSAISSDGGSEYYAGSVKGRFTISRDNAKNTVYLQMNSLKPEDTAVYYCAADPRRIG

ANIKYSDYWGQGTQVTVSS

IL6R120G6-GS9-IL6R103B2, SEQ ID NO: 861
EVQLVESGGDLVQTGGSLRLSCAASGITVSDRAMGWYRQAPGKQREMVAGVSRGGMTS

YADSVKGRLTISRDNAKNSVYLQMNSLNPEDTAVYYCSAYYRGSSVPQYWGQGTQVT

VSSGGGGSGGGSEVQLVESGGGLVQPGGSLRLSCAASGSTFSINMMAWYCQAPGKQRE

LVASISSGGGINYADSVKGRFTISRDYAENSVDLQMNSLKPEDTAVYYCNARGTYLNG

DHYSTNYNSWGQGTQVTVSS

IL6R105E1-GS9-IL6R100D11, SEQ ID NO: 862
EVQLVESGGGLVQAGGSLRLSCAASGSIFSIKAMGWYRQAPGKQRELVARITSGGSTY

YADSVKGRFTISRDNAKNTVYLQMNSLKPEDTAVFYCNAIVTDSDYDLGNDYWGQGTQ

VTVSSGGGGSGGGSEVQLVESGGGLVQAGDSLRLSCLASGRSFKDDAMGWFRQAPGKE

REFVSGIDWRGNIVDAESVKGRFTISRENAKNTLYLQMNHLKPEDTAVYYCAASSVFS

DLRYRKNPKYWGQGTQVTVSS

IL6R105E1-GS9-IL6R101B12, SEQ ID NO: 863
EVQLVESGGGLVQAGGSLRLSCAASGSIFSIKAMGWYRQAPGKQRELVARITSGGST

YYADSVKGRFTISRDNAKNTVYLQMNSLKPEDTAVFYCNAIVTDSDYDLGNDYWGQG

TQVTVSSGGGGSGGGSEVQLVESGGGLVQPGGSLRLSCAASGVTLDYYAIGWFRQAP

GKEREGVSSISSNDGSTFYADSVKGRFTISRDKAKNTVYLQMNSLKPEDTAVYYCAA

TYLTAQAVGVPVAYYEFDYWGQGTQVTVSS

IL6R105E1-GS9-IL6R107H2, SEQ ID NO: 864
EVQLVESGGGLVQAGGSLRLSCAASGSIFSIKAMGWYRQAPGKQRELVARITSGGST

YYADSVKGRFTISRDNAKNTVYLQMNSLKPEDTAVFYCNAIVTDSDYDLGNDYWGQG

TQVTVSSGGGGSGGGSKVQLVESGGGLVQPGGSLRLSCAASGFTFSSYAMSWVRRAP

GKGLEWVSAINSDGTGSSYAPFVTGRFTASRDNAKNTLYLQMNSLKPEDTAVYYCTN

SNRYDYADFSAVRGQGTQVTVSS

IL6R105E1-GS9-IL6R103A5, SEQ ID NO: 865
EVQLVESGGGLVQAGGSLRLSCAASGSIFSIKAMGWYRQAPGKQRELVARITSGGST

YYADSVKGRFTISRDNAKNTVYLQMNSLKPEDTAVFYCNAIVTDSDYDLGNDYWGQG

TQVTVSSGGGGSGGGSEVQLVESGGGLVQAGDSLRLSCVASGLPFSTLHMGWFRQAP

GKEHESVSAISSDGGSEYYAGSVKGRFTISRDNAKNTVYLQMNSLKPEDTAVYYCAA

DPRRIGANIKYSDYWGQGTQVTVSS

IL6R105E1-GS9-IL6R103B2, SEQ ID NO: 866
EVQLVESGGGLVQAGGSLRLSCAASGSIFSIKAMGWYRQAPGKQRELVARITSGGST

TABLE A-5-continued

Protein sequences of biparatopic anti-IL-6R Nanobodies
(IL6R-IL6 inhibiting block combined with a non-inhibiting,
IL6R binding block but not hybrid IL6R binding block)

YYADSVKGRFTISRDNAKNTVYLQMNSLKPEDTAVFYCNAIVTDSDYDLGNDYWGQG

TQVTVSSGGGGSGGGSEVQLVESGGGLVQPGGSLRLSCAASGSTFSINMMAWYCQAP

GKQRELVASISSGGGINYADSVKGRFTISRDYAENSVDLQMNSLKPEDTAVYYCNAR

GTYLNGDHYSTNYNSWGQGTQVTVSS

IL6R103C4-GS9-IL6R100D11, SEQ ID NO: 867
EVQLVESGGGLVEAGGSLRLSCAAAGRTLSSYSMAWFRQAPGKEREFVAIIRGNPSR

TYHSDSVKGRFTASRDNAKNTVYLQMNRLEPEDTAVYYDAADPPPFASDYSAPQSYD

YWGQGTQVTVSSGGGGSGGGSEVQLVESGGGLVQAGDSLRLSCLASGRSFKDDAMGW

FRQAPGKEREFVSGIDWRGNIVDAESVKGRFTISRENAKNTLYLQMNHLKPEDTAVY

YCAASSVFSDLRYRKNPKYWGQGTQVTVSS

IL6R103C4-GS9-IL6R101B12, SEQ ID NO: 868
EVQLVESGGGLVEAGGSLRLSCAAAGRTLSSYSMAWFRQAPGKEREFVAIIRGNPSR

TYHSDSVKGRFTASRDNAKNTVYLQMNRLEPEDTAVYYCAADPPPFASDYSAPQSYD

YWGQGTQVTVSSGGGGSGGGSEVQLVESGGGLVQPGGSLRLSCAASGVTLDYYAIGW

FRQAPGKEREGVSSISSNDGSTFYADSVKGRFTISRDKAKNTVYLQMNSLKPEDTAV

YYCAATYLTAQAVGVPVAYYEFDYWGQGTQVTVSS

IL6R103C4-GS9-IL6R107H2, SEQ ID NO: 869
EVQLVESGGGLVEAGGSLRLSCAAAGRTLSSYSMAWFRQAPGKEREFVAIIRGNPSR

TYHSDSVKGRFTASRDNAKNTVYLQMNRLEPEDTAVYYCAADPPPFASDYSAPQSYD

YWGQGTQVTVSSGGGGSGGGSKVQLVESGGGLVQPGGSLRLSCAASGFTFSSYAMSW

VRRAPGKGLEWVSAINSDGTGSSYAPFVTGRFTASRDNAKNTLYLQMNSLKPEDTAV

YYCTNSNRYDYADFSAVRGQGTQVTVSS

IL6R103C4-GS9-IL6R103A5, SEQ ID NO: 870
EVQLVESGGGLVEAGGSLRLSCAAAGRTLSSYSMAWFRQAPGKEREFVAIIRGNPSR

TYHSDSVKGRFTASRDNAKNTVYLQMNRLEPEDTAVYYCAADPPPFASDYSAPQSYD

YWGQGTQVTVSSGGGGSGGGSEVQLVESGGGLVQAGDSLRLSCVASGLPFSTLHMGW

FRQAPGKEHESVSAISSDGGSEYYAGSVKGRFTISRDNAKNTVYLQMNSLKPEDTAV

YYCAADPRRIGANIKYSDYWGQGTQVTVSS

IL6R103C4-GS9-IL6R103B2, SEQ ID NO: 871
EVQLVESGGGLVEAGGSLRLSCAAAGRTLSSYSMAWFRQAPGKEREFVAIIRGNPSR

TYHSDSVKGRFTASRDNAKNTVYLQMNRLEPEDTAVYYCAADPPPFASDYSAPQSYD

YWGQGTQVTVSSGGGGSGGGSEVQLVESGGGLVQPGGSLRLSCAASGSTFSINMMAW

YCQAPGKQRELVASISSGGGINYADSVKGRFTISRDYAENSVDLQMNSLKPEDTAVY

YCNARGTYLNGDHYSTNYNSWGQGTQVTVSS

IL6R103H9-GS9-IL6R100D11, SEQ ID NO: 872
EVQLVESGGGLVQPGGSLRLSCAASKSIFDINAMYWHRQAPGKQRESVASITSGGMR

NYADSVKDRFTISKDNAKNTVYLQMNGLKPDDTAVYYCGLGRYEGGVWRDYWGQGTQ

VTVSSGGGGSGGGSEVQLVESGGGLVQAGDSLRLSCLASGRSFKDDAMGWFRQAPGK

EREFVSGIDWRGNIVDAESVKGRFTISRENAKNTLYLQMNHLKPEDTAVYYCAASSV

FSDLRYRKNPKYWGQGTQVTVSS

IL6R103H9-GS9-IL6R101B12, SEQ ID NO: 873

TABLE A-5-continued

Protein sequences of biparatopic anti-IL-6R Nanobodies
(IL6R-IL6 inhibiting block combined with a non-inhibiting,
IL6R binding block but not hybrid IL6R binding block)

EVQLVESGGGLVQPGGSLRLSCAASKSIFDINAMYWHRQAPGKQRESVASITSGGMR

NYADSVKDRFTISKQNAKNTVYLQMNGLKPDDTAVYYCGLGRYEGGVWRDYWGQGTQ

VTVSSGGGGSGGGSEVQLVESGGGLVQPGGSLRLSCAASGVTLDYYAIGWFRQAPGK

EREGVSSISSNDGSTFYADSVKGRFTISRDKAKNTVYLQMNSLKPEDTAVYYCAATY

LTAQAVGVPVAYYEFDYWGQGTQVTVSS
IL6R103H9-GS9-IL6R107H2, SEQ ID NO: 874

EVQLVESGGGLVQPGGSLRLSCAASKSIFDINAMYWHRQAPGKQRESVASITSGGMR

NYADSVKDRFTISKDNAKNTVYLQMNGLKPDDTAVYYCGLGRYEGGVWRDYWGQGTQ

VTVSSGGGGSGGGSKVQLVESGGGLVQPGGSLRLSCAASGFTFSSYAMSWVRRAPGK

GLEWVSAINSDGTGSSYAPFVTGRFTASRDNAKNTLYLQMNSLKPEDTAVYYCTNSN

RYDYADFSAVRGQGTQVTVSS

IL6R103E9-GS9-IL6R103A5, SEQ ID NO: 875
EVQLVESGGGLVQPGGSLRLSCAASKSIFDINAMYWHRQAPGKQRESVASITSGGMR

NYADSVKDRFTISKDNAKNTVYLQMNGLKPDDTAVYYCGLGRYEGGVWRDYWGQGTQ

VTVSSGGGGSGGGSEVQLVESGGGLVQAGDSLRLSCVASGLPFSTLHMGWFRQAPGK

EHESVSAISSDGGSEYYAGSVKGRFTISRDNAKNTVYLQMNSLKPEDTAVYYCAADP

RRIGANIKYSDYWGQGTQVTVSS

IL6R103119-GS9-1L6R103B2, SEQ ID NO: 876
EVQLVESGGGLVQPGGSLRLSCAASKSIFDINAMYWHRQAPGKQRESVASITSGGMR

NYADSVKDRFTISKDNAKNTVYLQMNGLKPDDTAVYYCGLGRYEGGVWRDYWGQGTQ

VTVSSGGGGSGGGSEVQLVESGGGLVQPGGSLRLSCAASGSTFSINMMAWYCQAPGK

QRELVASISSGGGINYADSVKGRFTISRDYAENSVDLQMNSLKPEDTAVYYCNARGT

YLNGDHYSTNYNSWGQGTQVTVSS

IL6R107A1-GS9-IL6R100D11, SEQ ID NO: 877
EVQLVESGGGLVQAGGSLNLSCNASGDIGSINAMGWYRQAPGQQREWVAVITDTDST

IYPDSVKGRFAISRDGAKNTVHLRMSSLKPEDTAVYYCNAYQAGWGDYWGQGTQVTV

SEGGGGSGGGSEVQLVESGGGLVQAGDSLRLSCLASGRSFKDDAMGWFRQAPGKERE

FVSGIDWRGNIVDAESVKGRFTISRENAKNTLYLQMNHLKPEDTAVYYCAASSVFSD

LRYRKNPKYWGQGTQVTVSS

IL6R107A1-GS9-IL6R101B12, SEQ ID NO: 878
EVQLVESGGGLVQAGGSLNLSCNASGDIGSINAMGWYRQAPGQQREWVAVITDTDST

IYPDSVKGRFAISRDGAKNTVHLRMSSLKPEDTAVYYCNAYQAGWGDYWGQGTQVTV

SSGGGGSGGGSEVQLVESGGGLVQPGGSLRLSCAASGVTLDYYAIGWFRQAPG

KEREGVSSISSNDGSTFYADSVKGRFTISRDKAKNTVYLQMNSLKPEDTAVYYCAAT

YLTAQAVGVPVAYYEFDYWGQGTQVTVSS

IL6R107A1-GS9-IL6R107H2, SEQ ID NO: 879
EVQLVESGGGLVQAGGSLNLSCNASGDIGSINAMGWYRQAPGQQREWVAVITDTDST

IYPDSVKGRFAISRDGAKNTVHLRMSSLKPEDTAVYYQNAYQAGWGDYWGQGTQVTV

SSGGGGSGGGSKVQLVESGGGLVQPGGSLRLSCAASGFTFSSYAMSWVRRAPGKGLE

WVSAINSDGTGSSYAPFVTGRFTASRDNAKNTLYLQMNSLKPEDTAVYYCTNSNRYD

YADFSAVRGQGTQVTVSS

TABLE A-5-continued

Protein sequences of biparatopic anti-IL-6R Nanobodies (IL6R-IL6 inhibiting block combined with a non-inhibiting, IL6R binding block but not hybrid IL6R binding block)

IL6R107A1-GS9-IL6R103A5, SEQ ID NO: 880
EVQLVESGGGLVQAGGSLNLSCNASGDIGSINAMGWYRQAPGQQREWVAVITDTDST
IYPDSVKGRFAISRDGAKNTVHLRMSSLKPEDTAVYYCNAYQAGWGDYWGQGTQVTV
SSGGGGSGGGSEVQLVESGGGLVQAGDSLRLSCVASGLPFSTLHMGWFRQAPG
KEHESVSAISSDGGSEYYAGSVKGRFTISRDNAKNTVYLQMNSLKPEDTAVYYCAAD
PRRIGANIKYSDYWGQGTQVTVSS

IL6R107A1-GS9-IL6R103B2, SEQ ID NO: 881
EVQLVESGGGLVQAGGSLNLSCNASGDIGSINAMGWYRQAPGQQREWVAVITDTDST
IYPDSVKGRFAISRDGAKNTVHLRMSSLKPEDTAVYYCNAYQAGWGDYWGQGTQVTV
SSGGGGSGGGSEVQLVESGGGLVQPGGSLRLSCAASGSTFSINMMAWYCQAPGKQRE
LVASISSGGGINYADSVKGRFTISRDYAENSVDLQMNSLKPEDTAVYYCNARGTYLN
GDHYSTNYNSWGQGTQVTVSS

IL6R107A9-GS9-IL6R100D11, SEQ ID NO: 882
EVQLVESGGGLVQAGGSLRLSCAASGGIFSDMFMGWFRQAPGKSRESVARISPSGNT
FYQDSVRGRFTISTDNAKNTVYLQMNNLKPEDTAVYYCAANVGVTGSYEYWGQGTQV
TVSSGGGGSGGGSEVQLVESGGGLVQAGDSLRLSCLASGRSFKDDAMGWFRQAPGKE
REFVSGIDWRGNIVDAESVKGRFTISRENAKNTLYLQMNHLKPEDTAVYYCAASSVF
SDLRYRKNPKYWGQGTQVTVSS

IL6R107A9-GS9-IL6R101B12, SEQ ID NO: 883
EVQLVESGGGLVQAGGSLRLSCAASGGIFSDMFMGWFRQAPGKSRESVARISPSGNT
FYQDSVRGRFTISTDNAKNTVYLQMNNLKPEDTAVYYCAANVGVTGSYEYWGQGTQV
TVSSGGGGSGGGSEVQLVESGGGLVQPGGSLRLSCAASGVTLDYYAIGWFRQAPGKE
REGVSSISSNDGSTFYADSVKGRFTISRDKAKNTVYLQMNSLKPEDTAVYYCAATYL
TAQAVGVPVAYYEFDYWGQGTQVTVSS

IL6R107A9-GS9-IL6R107H2, SEQ ID NO: 884
EVQLVESGGGLVQAGGSLRLSCAASGGIFSDMFMGWFRQAPGKSRESVARISPSGNT
FYQDSVRGRFTISTDNAKNTVYLQMNNLKPEDTAVYYCAANVGVTGSYEYWGQGTQV
TVSSGGGGSGGGSKVQLVESGGGLVQPGGSLRLSCAASGFTFSSYAMSWVRRAPGKG
LEWVSAINSDGTGSSYAPFVTGRFTASRDNAKNTLYLQMNSLKPEDTAVYYCTNSNR
YDYADFSAVRGQGTQVTVSS

IL6R107A9-GS9-IL6R103A5, SEQ ID NO: 885
EVQLVESGGGLVQAGGSLRLSCAASGGIFSDMFMGWFRQAPGKSRESVARISPSGNT
FYQDSVRGRFTISTDNAKNTVYLQMNNLKPEDTAVYYCAANVGVTGSYEYWGQGTQV
TVSSGGGGSGGGSEVQLVESGGGLVQAGDSLRLSCVASGLPFSTLHMGWFRQAPGKE
HESVSAISSDGGSEYYAGSVKGRFTISRDNAKNTVYLQMNSLKPEDTAVYYCAADPR
RIGANIKYSDYWGQGTQVTVSS

IL6R107A9-GS9-IL6R103B2, SEQ ID NO: 886
EVQLVESGGGLVQAGGSLRLSCAASGGIFSDMFMGWFRQAPGKSRESVARISPSGNT
FYQDSVRGRFTISTDNAKNTVYLQMNNLKPEDTAVYYCAANVGVTGSYEYWGQGTQV
TVSSGGGGSGGGSEVQLVESGGGLVQPGGSLRLSCAASGSTFSINMMAWYCQAPGKQ
RELVASISSGGGINYADSVKGRFTISRDYAENSVDLQMNSLKPEDTAVYYCNARGTY
LNGDHYSTNYNSWGQGTQVTVSS

TABLE A-5-continued

Protein sequences of biparatopic anti-IL-6R Nanobodies
(IL6R-IL6 inhibiting block combined with a non-inhibiting,
IL6R binding block but not hybrid IL6R binding block)

IL6R120A5-GS35-IL6R100D11, SEQ ID NO: 887
EVQLVESGGGLVQAGGSLSLSCATSGRTISDDTMAWFRQAPGKEREFVAIITFNGAR

THYSDSVRDRFTISRDNAKNTVYLQMNSLKSEDTAVYYCAASTKYYSSTYNYIHPAF

YDIWGQGTQVTVSSGGGGSGGGGSGGGGSGGGGSGGGGSGGGGSGGGGSEVQLVESG

GGLVQAGDSLRLSCLASGRSFKDDAMGWFRQAPGKEREFVSGIDWRGNIVDAESVKG

RFTISRENAKNTLYLQMNHLKPEDTAVYYCAASSVFSDLRYRKNPKYWGQGTQVTVSS

IL6R120A5-GS35-IL6R101B12, SEQ ID NO: 888
EVQLVESGGQLVQAGGSLSLSCATSGRTISDDTMAWFRQAPGKEREFVAIITFNGAR

THYSDSVRDRFTISRDNAKNTVYLQMNSLKSEDTAVYYCAASTKYYSSTYNYIHPAF

YDIWGQGTQVTVSSGGGGSGGGGSGGGGSGGGGSGGGGSGGGGSGGGGSEVQLVESG

GGLNQPGGSLRLSCAASGVTLDYYAIGWFRQAPGKEREGVSSISSNDGSTFYADSVK

GRFTISRDKAKNTVYLQMNSLKPEDTAVYYCAATYLTAQAVGVPVAYYEFDYWGQGT

QVTVSS

IL6R120A5-GS35-IL6R107H2, SEQ ID NO: 889
EVQLVESGGGLVQAGGSLSLSCATSGRTISDDTMAWFRQAPGKEREFVAIITFNGAR

THYSDSVRDRFTISRDNAKNTVYLQMNSLKSEDTAVYYCAASTKYYSSTYNYIHPAF

YDIWGQGTQVTVSSGGGGSGGGGSGGGGSGGGGSGGGGSGGGGSGGGGSKVQLVESG

GGLVQPGGSLRLSCAASGFTFSSYAMSWVRRAPGKGLEWVSAINSDGTGSSYAPFVT

GRFTASRDNAKNTLYLQMNSLYPEDTAVYYCTNSNRYDYADFSAVRGQGTQVTVSS

IL6R120A5-GS35-IL6R103A5, SEQ ID NO: 890
EVQLVESGGGLVQAGGSLSLSCATSGRTISDDTMAWFRQAPQKEREFVAIITFNGAR

THYSDSVRDRFTISRDNAKNTVYLQMNSLKSEDTAVYYCAASTKYYSSTYNYIHPAF

YDIWGQGTQVTVSSGGGGSGGGGSGGGGSGGGGSGGGGSGGGGSGGGGSEVQLVESG

GGLVQAGDSLRLSCVASGLPFSTLHMGWFRQAPGKEHESVSAISSDGGSEYYAGSVK

GRFTISRDNAKNTVYLQMNSLKPEDTAVYYCAADPRRIGANIKYSDYWGQGTQVTVSS

IL6R120A5-GS35-IL6R103B2, SEQ ID NO: 891
EVQLVESGGGLVQAGGSLSLSCATSGRTISDDTMAWFRQAPGKEREFVAIITFNGAR

THYSDSVRDRFTISRDNAKNTVYLQMNSLKSEDTAVYYCAASTKYYSSTYNYIHPAF

YDIWGQGTQVTVSSGGGGSGGGGSGGGGSGGGGSGGGGSGGGGSGGGGSEVQLVESG

GGLVQPGGSLRLSCAASGSTFSINMMAWYCQAPGKQRELVASISSGGGINYADSVKG

RFTISRDYAENSVDLQMNSLKPEDTAVYYCNARGTYLNGDHYSTNYNSWGQGTQVTVSS

IL6R120G6-GS35-IL6R100D11, SEQ ID NO: 892
EVQLVESGGDLVQTGGSLRLSCAASGITVSDRAMGWYRQAPGKQREMVAGVSRGGMT

SYADSVEGRLTISRDNAKNSVYLQMNSLNPEDTAVYYCSAYYRYGSSVPQYWGQGTQ

VTVSSGGGGSGGGGSGGGGSGGGGSGGGGSGGGGSGGGGSEVQLVESGGGLVQAGDS

LRLSCLASGRSFKDDAMGWFRQAPGKEREFVSGIDWRGNIVDAESVKGRFTISRENA

KNTLYLQMNHLKPEDTAVYYCAASSVFSDLRYRKNPKYWGQGTQVTVSS

IL6R120G6-GS35-IL6R101B12, SEQ ID NO: 893
EVQLVESGGDLVQTGGSLRLSCAASGITVSDRAMGWYRQAPGKQREMVAGVSRGGMT

SYADSVKGRLTISRDNAKNSVYLQMNSLNPEDTAVYYCSAYYRYGSSVPQYWGQGTQ

VTVSSGGGGSGGGGSGGGGSGGGGSGGGGSGGGGSGGGGSEVQLVESGGGLVQPGGS

TABLE A-5-continued

Protein sequences of biparatopic anti-IL-6R Nanobodies
(IL6R-IL6 inhibiting block combined with a non-inhibiting,
IL6R binding block but not hybrid IL6R binding block)

LRLSCAASGVTLDYYAIGWFRQAPGKEREGVSSISSNDGSTFYADSVKGRFTISRDK

AKNTVYLQMNSLKPEDTAVYYCAATYLTAQAVGVPVAYYEFDYWGQGTQVTVSS

IL6R120G6-GS35-IL6R107H2, SEQ ID NO: 894
EVQLVESGGDLVQTGGSLRLSCAASGITVSDRAMGWYRQAPGKQREMVAGVSRGGMT

SYADSVKGRLTISRDNAKNSVYLQMNSLNPEDTAVYYCSAYYRYGSSVPQYWGQGTQ

VTVSSGGGGSGGGGSGGGGSGGGGSGGGGSGGGGSGGGGSKVQLVESGGGLVQPGGS

LRLSCAASGFTFSSYAMSWVRRAPGKGLEWVSAINSDGTGSSYAPFVTGRFTASRDN

AKNTLYLQMNSLKPEDTAVYYCTNSNRYDYADFSAVRGQGTQVTVSS

IL6R120G6-GS35-IL6R103A5, SEQ ID NO: 895
EVQLVESGGDLVQTGGSLRLSCAASGITVSDRAMGWYRQAPGKQREMVAGVSRGGMT

SYADSVKGRLTISRDNAKNSVYLQMNSLNPEDTAVYYCSAYYRYGSSVPQYWGQGTQ

VTVSSGGGGSGGGGSGGGGSGGGGSGGGGSGGGGSGGGGSEVQLVESGGGLVQAGDS

LRLSCVASGLPFSTLHMGWFRQAPGKEHESVSAISSDGGSEYYAGSVKGRFTISRDN

AKNTVYLQMNSLKPEDTAVYYCAADPRRIGANIKYSDYWGQGTQVTVSS

IL6R120G6-GS35-IL6R103B2, SEQ ID NO: 896
EVQLVESGGDLVQTGGSLRLSCAASGITVSDRAMGWYPQAPGKQREMVAGVSRGGMT

SYADSVKGRLTISRDNAKNSVYLQMNSLNPEDTAVYYCSAYYRYGSSVPQYWGQGTQ

VTVSSGGGGSGGGGSGGGGSGGGGSGGGGSGGGGSGGGGSEVQLVESGGGLVQPGGS

LRLSCAASGSTFSINMMAWYCQAPGKQRELVASISSGGGINYADSVYGRFTISRDYA

ENSVDLQMNSLKPEDTAVYYCNARGTYLNGDHYSTNYNSWGQGTQVTVSS

IL6R105E1-GS35-IL6R100D11, SEQ ID NO: 897
EVQLVESGGGLVQAGGSLRLSCAASGSIFSIKAMGWYRQAPGKQRELVARITSGGST

YYADSVKGRFTISRDNAKNTVYLQMNSLKPEDTAVFYQNAIVTDSDYDLGNDYWGQG

TQVTVSSGGGGSGGGGSGGGGSGGGGSGGGGSGGGGSGGGGSEVQLVESGGGLVQAG

DSLRLSCLASGRSFKDDAMGWFRQAPGKEREFVSGIDWRGNIVDAESVKGRFTISRE

NAKNTLYLQMNHLKPEDTAVYYCAASSVESDLRYRKNPKYWGQGTQVTVSS

IL6R105E1-GS35-IL6R101B12, SEQ ID NO: 898
EVQLVESGGGLVQAGGSLRLSCAASGSIFSIKAMGWYRQAPGKQRELVARITSGGST

YYADSVKGRFTISRDNAKNTVYLQMNSLKPEDTAVFYCNAIVTDSDYDLGNDYWGQG

TQVTVSSGGGGSGGGGSGGGGSGGGGSGGGGSGGGGSGGGGSEVQLVESGGGLVQPG

GSLRLSCAASGVTLDYYAIGWFRQAPGKEREGVSSISSNDGSTFYADSVKGRFTISR

DKAKNTVYLQMNSLKPEDTAVYYCAATYLTAQAVGVAVAYYEFDYWGQGTQVTVSS

IL6R105E1-GS35-IL6R107H2, SEQ ID NO: 899
EVQLVESGGGLVQAGGSLRLSCAASGSIFSIKAMGWYRQAPGKQRELVARITSGGST

YYADSVKGRFTISRDNAKNTVYLQMNSLKPEDTAVFYCNAIVTDSDYDLGNDYWGQG

TQVTVSSGGGGSGGGGSGGGGSGGGGSGGGGSGGGGSGGGGSKVQLVESGGGLVQPG

GSLRLSCAASGFTFSSYAMSWVRRAPGKGLEWVSAINSDGTGSSYAPFVTGRFTASR

DNAKNTLYLQMNSLKPEDTAVYYQTNSNRYDYADFSAVRGQGTQVTVSS

IL6R105E1-GS35r-IL6R103A5, SEQ ID NO: 900
EVQLVESGGGLVQAGGSLRLSCAASGSIFSIKAMGWYRQAPGKQRELVARITSGGST

YYADSVKGRFTISRDNAKNTVYLQMNSLKPEDTAVFYCNAIVTDSDYDLGNDYWGQG

TQVTVSSGGGGSGGGGSGGGGSGGGGSGGGGSGGGGSGGGGSEVQLVESGGGLVQAG

TABLE A-5-continued

Protein sequences of biparatopic anti-IL-6R Nanobodies
(IL6R-IL6 inhibiting block combined with a non-inhibiting,
IL6R binding block but not hybrid IL6R binding block)

DSLRLSCVASGLPFSTLHMGWFRQAPGKEHESVSAISSDGGSEYYAGSVKGRFTISR

DNAKNTVYLQMNSLKPEDTAVYYCAADPRRIGANIKYSDYWGQGTQVTVSS

IL6R105E1-GS35-IL6R103B2, SEQ ID NO: 901
EVQLVESGGGLVQAGGSLRLSCAASGSIFSIKAMGWYRQAPGKQRELVARITSGGST

YYADSVKGRFTISRDNAKNTVYLQMNSLKPEDTAVFYCNAIVTDSDYDLGNDYWGQG

TQVTVSSGGGGSGGGGSGGGGSGGGGSGGGGSGGGGSGGGGSEVQLVESGGGLVQPG

GSLRLSCAASGSTFSINMMAWYCQAPGKQRELVASISSGGGINYADSVKGRFTISRD

YAENSVDLQMNSLKPEDTAVYYCNARGTYLNGDHYSTNYNSWGQGTQVTVSS

IL6R103C4-GS35-IL6R100D11, SEQ ID NO: 902
EVQLVESGGGLVEAGGSLRLSCAAAGRTLSSYSMAWFRQAPGKEREFVAIIRGNPSR

TYHSDSVKGRFTASRDNAKNTVYLQMNRLEPEDTAVYYCAADPPPFASDYSAPQSYD

YWGQGTQVTVSSGGGGSGGGGSGGGGSGGGGSGGGGSGGGGSGGGGSEVQLVESGGG

LVQAGDSLRLSCLASGRSFKDDAMGWFRQAPGKEREFVSGIDWRGNIVDAESVKGRF

TISRENAKNTLYLQMNHLKPEDTAVYYCAASSVFSDLRYRKNPKYWGQGTQVTVSS

IL6R103C4-GS35-IL6R101B12, SEQ ID NO: 903
EVQLVESGGGLVEAGGSLRLSCAAAGRTLSSYSMAWFRQAPGKEREFVAIIRGNPSR

TYHSDSVKGRFTASRDNAKNTVYLQMNRLEPEDTAVYYCAADPPPFASDYSAPQSYD

YWGQGTQVTVSSGGGGSGGGGSGGGGSGGGGSGGGGSGGGGSGGGGSEVQLVESGGG

LVQPGGSLRLSCAASGVTLDYYAIGWFRQAPGKEREGVSSISSNDGSTFYADSVKGR

FTISRDKAKNTVYLQMNSLKPEDTAVYYCAATYLTAQAVGVPVAYYEFDYWGQGTQV

TVSS

IL6R103C4-GS35-IL6R107H2, SEQ ID NO: 904
EVQLVESGGGLVEAGGSLRLSCAAAGRTLSSYSMAWFRQAPGKEREFVAIIRGNPSR

TYHSDSVKGRFTASRDNAKNTVYLQMNRLEPEDTAVYYCAADPPPFASDYSAPQSYD

YWGQGTQVTVSSGGGGSGGGGSGGGGSGGGGSGGGGSGGGGSGGGGSKVQLVESGGG

LVQPGGSLRLSCAASGFTFSSYAMSWVRRAPGKGLEWVSAINSDGTGSSYAPFVTGR

FTASRDNAKNTLYLQMNSLKPEDTAVYYCTNSNRYDYADFSAVRGQGTQVTVSS

IL6R103C4-GS35-IL6R103A5, SEQ ID NO: 905
EVQLVESGGGLVEAGGSLRLSCAAAGRTLSSYSMAWFRQAPGKEREFVAIIRGNPSR

TYHSDSVKGRFTASRDNAKNTVYLQMNRLEPEDTAVYYCAADPPPFASDYSAPQSYD

YWGQGTQVTVSSGGGGSGGGGSGGGGSGGGGSGGGGSGGGGSGGGGSEVQLVESGGG

LVQAGDSLRLSCVASGLPFSTLHMGWFRQAPGKEHESVSAISSDGGSEYYAGSVKGR

FTISRDNAKNTVYLQMNSLKPEDTAVYYCAADPRRIGANIKYSDYWGQGTQVTVSS

IL6R103C4-GS35-IL6R103B2, SEQ ID NO: 906
EVQLVESGGGLVEAGGSLRLSCAAAGRTLSSYSMAWFRQAPGKEREFVAIIRGNPSR

TYHSDSVKGRFTASRDNAKNTVYLQMNRLEPEDTAVYYCAADPPPFASDYSAPQSYD

YWGQGTQVTVSSGGGGSGGGGSGGGGSGGGGSGGGGSGGGGSGGGGSEVQLVESGGG

LVQPGGSLRLSCAASGSTFSINMMAWYCQAPGKQRELVASISSGGGINYADSVKGRF

TISRDYAENSVDLQMNSLKPEDTAVYYCNARGTYLNGDHYSTNYNSWGQGTQVTVSS

IL6R103H9-GS35-IL6R100D11, SEQ ID NO: 907
EVQLVESGGGLVQPGGSLRLSCAASKSIFDINAMYWHRQAPGKQRESVASITSGGMR

TABLE A-5-continued

Protein sequences of biparatopic anti-IL-6R Nanobodies
(IL6R-IL6 inhibiting block combined with a non-inhibiting,
IL6R binding block but not hybrid IL6R binding block)

NYADSVKDRETISKDNAKNTVYLQMNGLKPDDTAVYYCGLGRYEGGVWRDYWGQGTQ

VTVSSGGGGSGGGGSGGGGSGGGGSGGGGSGGGGSGGGGSEVQLVESGGGLVQAGDS

LRLSCLASGRSFKDDAMGWFRQAPGKEREFVSGIDWRGNIVDAESVKGRFTISRENA

KNTLYLQMNHLKPEDTAVYYCAASSVFSDLRYRKNPKYWGQGTQVTVSS

IL6R103H9-GS35-IL6R101B12, SEQ ID NO: 908
EVQLVESGGGLVQPGGSLRLSCAASKSIFDINAMYWHRQAPGKQRESVASITSGGMR

NYADSVKDRFTISKDNAKNTVYLQMNGLKPDDTAVYYCGLGRYEGGVWRDYWGQGTQ

VTVSSGGGGSGGGGSGGGGSGGGGSGGGGSGGGGSGGGGSEVQLVESGGGLVQPGGS

LRLSCAASGVTLDYYAIGWFRQAPGKEREGVSSISSNDGSTFYADSVKGRFTISRDK

AKNTVYLQMNSLKPEDTAVYYCAATYLTAQAVGVPVAYYEFDYWGQGTQVTVSS

IL6R103H9-GS35-IL6R107H2, SEQ ID NO: 909
EVQLVESGGGLVQPGGSLRLSCAASKSIFDINAMYWHRQAPGKQRESVASITSGGMR

NYADSVKDRFTISKDNAKNTVYLQMNGLKPDDTAVYYCGLGRYEGGVWRDYWGQGTQ

VTVSSGGGGSGGGGSGGGGSGGGGSGGGGSGGGGSGGGGSKVQLVESGGGLVQPGGS

LRLSCAASGFTFSSYAMSWVRRAPGKGLEWVSAINSDGTGSSYAPFVTGRFTASRDN

AKNTLYLQMNSLKPEDTAVYYCTNSNRYDYADFSAVRGQGTQVTVSS

IL6R103H9-GS35-IL6R103A5, SEQ ID NO: 910
EVQLVESGGGLVQPGGSLRLSCAASKSIFDINAMYWHRQAPGKQRESVASITSGGMR

NYADSVKDRFTISKDNAKNTVYLQMNGLKPDDTAVYYCGLGRYEGGVWRDYWGQGTQ

VTVSSGGGGSGGGGSGGGGSGGGGSGGGGSGGGGSGGGGSEVQLVESGGGLVQAGDS

LRLSCVASGLPFSTLHMGWFRQAPGKEHESVSAISSDGGSEYYAGSVKGRFTISRDN

AKNTVYLQMNSLKPEDTAVYYCAADPRRIGANIKYSDYWGQGTQVTVSS

IL6R103H9-GS35-IL6R103B2, SEQ ID NO: 911
EVQLVESGGGLVQPGGSLRLSCAASKSIFDINAMYWHRQAPGKQRESVASITSGGMRN

YADSVKDRFTISKDNAKNTVYLQMNGLKPDDTAVYYCGLGRYEGGVWRDYWGQGTQVT

VSSGGGGSGGGGSGGGGSGGGGSGGGGSGGGGSGGGGSEVQLVESGGGLVQPGGSLRL

SCAASGSTFSINMMAWYCQAPGKQRELVASISSGGGINYADSVKGRFTISRDYAENSV

DLQMNSLKPEDTAVYYCNARGTYLNGDHYSTNYNSWGQGTQVTVSS

IL6R107A1-GS35-IL6R100D11, SEQ ID NO: 912
EVQLVESGGGLVQAGGSLNLSCNASGDIGSINAMGWYRQAPGQQREWVAVITDTDSTI

YPDSVKGRFAISRDGAKNTVHLRMSSLKPEDTAVYYCNAYQAGWGDYWGQGTQVTVSS

GGGGSGGGGSGGGGSGGGGSGGGGSGGGGSGGGGSEVQLVESGGGLVQAGDSLRLSCL

ASGRSFKDDAMGWFRQAPGKEREFVSGIDWRGNIVDAESVKGRFTISRENAKNTLYLQ

MNHLKPEDTAVYYCAASSVFSDLRYRKNPKYWGQGTQVTVSS

IL6R107A1-GS35-IL6R101B12, SEQ ID NO: 913
EVQLVESGGGLVQAGGSLNLSCNASGDIGSINAMGWYRQAPGQQREWVAVITDTDSTI

YPDSVKGRFAISRDGAKNTVHLRMSSLKPEDTAVYYCNAYQAGWGDYWGQGTQVTVSS

GGGGSGGGGSGGGGSGGGGSGGGGSGGGGSGGGGSEVQLVESGGGLVQPGGSLRLSCA

ASGVTLDYYAIGWFRQAPGKEREGVSSISSNDGSTFYADSVKGRFTISRDKAKNTVYL

QMNSLKPEDTAVYYCAATYLTAQAVGVPVAYYEFDYWGQGTQVTVSS

IL6R107A1-GS35-IL6R107H2, SEQ ID NO: 914
EVQLVESGGGLVQAGGSLNLSCNASGDIGSINAMGWYRQAPGQQREWVAVITDTDSTI

TABLE A-5-continued

Protein sequences of biparatopic anti-IL-6R Nanobodies
(IL6R-IL6 inhibiting block combined with a non-inhibiting,
IL6R binding block but not hybrid IL6R binding block)

YPDSVKGRFAISRDGAKNTVHLRMSSLKPEDTAVYYCNAYQAGWGDYWGQGTQVTVSS

GGGGSGGGGSGGGGSGGGGSGGGGSGGGGSGGGGSGGGGSKVQLVESGGGLVQPGGSLRLSCA

ASGFTFSSYAMSWVRRAPGKGLEWVSAINSDGTSSYAPFVTGRFTASRDNAKNTLYL

QMNSLKPEDTAVYYCTNSNRYDYADFSAVRGQGTQVTVSS

IL6R107A1-GS35-IL6R103A5, SEQ ID NO: 915
EVQLVESGGGLVQAGGSLNLSCNASGDIGSINAMGWYRQAPGQQREWVAVITDTDSTI

YPDSVKGRFAISRDGAKNTVHLRMSSLKPEDTAVYYCNAYQAGWGDYWGQGTQVTVSS

GGGGSGGGGSGGGGSGGGGSGGGGSGGGGSGGGGSEVQLVESGGGLVQAGDSLRLSCV

ASGLPFSTLHMGWFRQAPGKEHESVSAISSDGGSEYYAGSVKGRFTISRDNAKNTVYL

QMNSLKPEDTAVYYCAADPRRIGANIKYSDYWGQGTQVTVSS

IL6R107A1-GS35-IL6R103B2, SEQ ID NO: 916
EVQLVESGGGLVQAGGSLNLSCNASGDIGSINAMGWYRQAPGQQREWVAVITDTDSTI

YPDSVKGRFAISRDGAKNTVHLRMSSLKPEDTAVYYCNAYQAGWGDYWGQGTQVTVSS

GGGGSGGGGSGGGGSGGGGSGGGGSGGGGSGGGGSEVQLVESGGGLVQPGGSLRLSCA

ASGSTFSINMMAWYCQAPGKQRELVASISSGGGINYADSVKGRFTISRDYAENSVDLQ

MNSLKPEDTAVYYCNARGTYLNGDHYSTNYNSWGQGTQVTVSS

IL6R107A9-GS35-IL6R100D11, SEQ ID NO: 917
EVQLVESGGGLVQAGGSLRLSCAASGGIFSDMFMGWFRQAPGKSRESVARISPSGNTFY

QDSVRGRFTISTDNAKNTVYLQMNNLKPEDTAVYYCAANVGVTGSYEYWGQGTQVTVSS

GGGGSGGGGSGGGGSGGGGSGGGGSGGGGSGGGGSEVQLVESGGGLVQAGDSLRLSCLA

SGRSFKDDAMGWFRQAPGKEREFVSGIDWRGNIVDAESVKGRFTISRENAKNTLYLQMN

HLKPEDTAVYYCAASSVFSDLRYRKNPKYWGQGTQVTVSS

IL6R107A9-GS35-IL6R101B12, SEQ ID NO: 918
EVQLVESGGGLVQAGGSLRLSCAASGGIFSDMFMGWFRQAPGKSRESVARISPSGNTFY

QDSVRGRFTISTDNAKNTVYLQMNNLKPEDTAVYYCAANVGVTGSYEYWGQGTQVTVSS

GGGGSGGGGSGGGGSGGGGSGGGGSGGGGSGGGGSEVQLVESGGGLVQPGGSLRLSCAA

SGVTLDYYAIGWFRQAPGKEREGVSSISSNDGSTFYADSVKGRFTISRDKAKNTVYLQM

NSLKPEDTAVYYCAATYLTAQAVGVPVAYYEFDYWGQGTQVTVSS

IL6R107A9-GS35-IL6R107H2, SEQ ID NO: 919
EVQLVESGGGLVQAGGSLRLSCAASGGIFSDMFMGWFRQAPGKSRESVARISPSGNTFY

QDSVRGRFTISTDNAKNTVYLQMNNLKPEDTAVYYCAANVGVTGSYEYWGQGTQVTVSS

GGGGSGGGGSGGGGSGGGGSGGGGSGGGGSGGGGSKVQLVESGGGLVQPGGSLRLSCAA

SGFTFSSYAMSWVRRAPGKGLEWVSAINSDGTSSYAPFVTGRFTASRDNAKNTLYLQM

NSLKPEDTAVYYCTNSNRYDYADFSAVRGQGTQVTVSS

IL6R107A9-GS35-IL6R103A5, SEQ ID NO: 920
EVQLVESGGGLVQAGGSLRLSCAASGGIFSDMFMGWFRQAPGKSRESVARISPSGNTFY

QDSVRGRFTISTDNAKNTVYLQMNNLKPEDTAVYYCAANVGVTGSYEYWGQGTQVTVS

SGGGGSGGGGSGGGGSGGGGSGGGGSGGGGSGGGGSEVQLVESGGGLVQAGDSLRLSC

VASGLPFSTLHMGWFRQAPGKEHESVSAISSDGGSEYYAGSVKGRFTISRDNAKNTVY

LQMNSLKPEDTAVYYCAADPRRIGANIKYSDYWGQGTQVTVSS

IL6R107A9-GS35-IL6R103B2, SEQ ID NO: 921

TABLE A-5-continued

Protein sequences of biparatopic anti-IL-6R Nanobodies
(IL6R-IL6 inhibiting block combined with a non-inhibiting,
IL6R binding block but not hybrid IL6R binding block)

EVQLVESGGGLVQAGGSLRLSCAASGGIFSDMFMGWFRQAPGKSRESVARISPSGNTF

YQDSVRGRFTISTDNAKNTVYLQMNNLKPEDTAVYYCAANVGVTGSYEYWGQGTQVTV

SSGGGGSGGGGSGGGGSGGGGSGGGGSGGGGSGGGGSEVQLVESGGGLVQPGGSLRLS

CAASGSTFSINMMAWYCQAPGKQRELVASISSGGGINYADSVKGRFTISRDYAENSVD

LQMNSLKPEDTAVYYCNARGTYLNGDHYSTNYNSWGQGTQVTVSS

IL6R101B12-GS35-IL6R105E1, SEQ ID NO: 947
EVQLVESGGGLVQPGGSLRLSCAASGVTLDYYAIGWFRQAPGKEREGVSSISSNDGSTF

YADSVKGRFTISRDKAKNTVYLQMNSLKPEDTAVYYCAATYLTAQAVGVPVAYYEFDYW

GQGTQVTVSSGGGGSGGGGSGGGGSGGGGSGGGGSGGGGSGGGGSEVQLVESGGGLVQA

GGSLRLSCAASGSIFSIKAMGWYRQAPGKQRELVARITSGGSTYYADSVKGRFTISRDN

AKNTVYLQMNSLKPEDTAVFYCNAIVTDSDYDLGNDYWGQGTQVTVSS

TABLE A-6

Protein sequences of biparatopic anti-IL-6R Nanobodies
(IL6R-IL6 inhibiting block combined with a another
IL6R-IL6 inhibiting binding block)

IL6R120A5-GS9-IL6R100G11, SEQ ID NO: 922
EVQLVESGGGLVQAGGSLSLSCATSGRTISDDTMAWFRQAPGKEREFVAIITFNGART

HYSDSVRDRFTISRDNAKNTVYLQMNSLKSEDTAVYYCAASTKYYSSTYNYIHPAFYD

IWGQGTQVTVSSGGGGSGGGSEVQLVESGGGLVQAGGSLRLSCAASGRGFSPYTMGWF

RQAPGKERVFVAGISWSTGIAHYTDSVKGRFTISRDNAKNTGSLQMNSLKPEDTAVYY

CAVVQTTKGNYDYWGQGTQVTVSS

IL6R120A5-GS9-IL6R120G6, SEQ ID NO: 923
EVQLVESGGGLVQAGGSLSLSCATSGRTISDDTMAWFRQAPGKEREFVAIITFNGART

HYSDSVRDRFTISRDNAKNTVYLQMNSLKSEDTAVYYCAASTKYYSSTYNYIHPAFYD

IWGQGTQVTVSSGGGGSGGGSEVQLVESGGDLVQTGGSLRLSCAASGITVSDRAMGWY

RQAPGKQREMVAGVSRGGMTSYADSVKGRLTISRDNAKNSVYLQMNSLNPEDTAVYYC

SAYYRYGSSVPQYWGQGTQVTVSS

IL6R120A5-GS9-IL6R105E1, SEQ ID NO: 924
EVQLVESGGGLVQAGGSLSLSCATSGRTISDDTMAWFRQAPGKEREFVAIITFNGART

HYSDSVRDRFTISRDNAKNTVYLQMNSLKSEDTAVYYCAASTKYYSSTYNYIHPAFYD

IWGQGTQVTVSSGGGGSGGGSEVQLVESGGGLVQAGGSLRLSCAASGSIFSIKAMGWY

RQAPGKQRELVARITSGGSTYYADSVKGRFTISRDNAKNTVYLQMNSLKPEDTAVFYC

NAIVTDSDYDLGNDYWGQGTQVTVSS

IL6R120A5-GS9-IL6R104B8, SEQ ID NO: 925
EVQLVESGGGLVQAGGSLSLSCATSGRTISDDTMAWFRQAPGKEREFVAIITFNGART

HYSDSVRDRFTISRDNAKNTVYLQMNSLKSEDTAVYYCAASTKYYSSTYNYIHPAFYD

IWGQGTQVTVSSGGGGSGGGSEVQLVESGGGLVQAGGSLRLSCAASGFAFDDYAIGWF

RQAPGKEREGVSSISSSNGNTYYADSVRGRFTISSDNAKNTVYLQMNSLKPEDTGVYY

CAAIWGIFFNEKMPVGAYDYWGQGTQVTVSS

IL6R120A5-GS9-IL6R103C4, SEQ ID NO: 926
EVQLVESGGGLVQAGGSLSLSCATSGRTISDDTMAWFRQAPGKEREFVAIITFNGART

TABLE A-6-continued

Protein sequences of biparatopic anti-IL-6R Nanobodies
(IL6R-IL6 inhibiting block combined with a another
IL6R-IL6 inhibiting binding block)

HYSDSVRDRFTISRDNAKNTVYLQMNSLKSEDTAVYYCAASTKYYSSTYNYIHPAFYD

IWGQGTQVTVSSGGGGSGGGSEVQLVESGGGLVEAGGSLRLSCAAAGRTLSSYSMAWF

RQAPGKEREFVAIIRGNPSRTYHSDSVKGRFTASRDNAKNTVYLQMNRLEPEDTAVYY

CAADPPPFASDYSAPQSYDYWGQGTQVTVSS

IL6R120G6-GS9-IL6R100G11, SEQ ID NO: 927
EVQLVESGGDLVQTGGSLRLSCAASGITVSDRAMGWYRQAPGKQREMVAGVSRGGMTS

YADSVKGRLTISRDNAKNSVYLQMNSLNPEDTAVYYCSAYYRYGSSVPQYWGQGTQVT

VSSGGGGSGGGSEVQLVESGGGLVQAGGSLRLSCAASGRGFSPYTMGWFRQAPGKERV

FVAGISWSTGIAHYTDSVKGRFTISRDNAKNTGSLQMNSLKPEDTAVYYCAVVQTTKG

NYDYWGQGTQVTVSS

IL6R120G6-GS9-IL6R105E1, SEQ ID NO: 928
EVQLVESGGDLVQTGGSLRLSCAASGITVSDRAMGWYRQAPGKQREMVAGVSRGGMTS

YADSVKGRLTISRDNAKNSVYLQMNSLNPEDTAVYYCSAYYRYGSSVPQYWGQGTQVT

VSSGGGGSGGGSEVQLVESGGGLVQAGGSLRLSCAASGSIFSIKAMGWYRQAPGKQRE

LVARITSGGSTYYADSVKGRFTISRDNAKNTVYLQMNSLKPEDTAVFYCNAIVTDSDY

DLGNDYWGQGTQVTVSS

IL6R120G6-GS9-IL6R104B8, SEQ ID NO: 929
EVQLVESGGDLVQTGGSLRLSCAASGITVSDRAMGWYRQAPGKQREMVAGVSRGGMTS

YADSVKGRLTISRDNAKNSVYLQMNSLNPEDTAVYYCSAYYRYGSSVPQYWGQGTQVT

VSSGGGGSGGGSEVQLVESGGGLVQAGGSLRLSCAASGFAFDDYAIGWFRQAPGKERE

GVSSISSSNGNTYYADSVRGRFTISSDNAKNTVYLQMNSLKPEDTGVYYCAAIWGIFF

NEKMPVGAYDYWGQGTQVTVSS

IL6R120G6-GS9-IL6R103C4, SEQ ID NO: 930
EVQLVESGGDLVQTGGSLRLSCAASGITVSDRAMGWYRQAPGKQREMVAGVSRGGMTS

YADSVKGRLTISRDNAKNSVYLQMNSLNPEDTAVYYCSAYYRYGSSVPQYWGQGTQVT

VSSGGGGSGGGSEVQLVESGGGLVEAGGSLRLSCAAAGRTLSSYSMAWFRQAPGKERE

FVAIIRGNPSRTYHSDSVKGRFTASRDNAKNTVYLQMNRLEPEDTAVYYCAADPPPFA

SDYSAPQSYDYWGQGTQVTVSS

IL6R105E1-GS9-IL6R100G11, SEQ ID NO: 931
EVQLVESGGGLVQAGGSLRLSCAASGSIFSIKAMGWYRQAPGKQRELVARITSGGSTY

YADSVKGRFTISRDNAKNTVYLQMNSLKPEDTAVFYCNAIVTDSDYDLGNDYWGQGTQ

VTVSSGGGGSGGGSEVQLVESGGGLVQAGGSLRLSCAASGRGFSPYTMGWFRQAPGKE

RVFVAGISWSTGIAHYTDSVKGRFTISRDNAKNTGSLQMNSLKPEDTAVYYCAVVQTT

KGNYDYWGQGTQVTVSS

IL6R105E1-GS9-IL6R104B8, SEQ ID NO: 932
EVQLVESGGGLVQAGGSLRLSCAASGSIFSIKAMGWYRQAPGKQRELVARITSGGSTY

YADSVKGRFTISRDNAKNTVYLQMNSLKPEDTAVFYCNAIVTDSDYDLGNDYWGQGTQ

VTVSSGGGGSGGGSEVQLVESGGGLVQAGGSLRLSCAASGFAFDDYAIGWFRQAPGKE

REGVSSISSSNGNTYYADSVRGRFTISSDNAKNTVYLQMNSLKPEDTGVYYCAAIWGI

FFNEKMPVGAYDYWGQGTQVTVSS

IL6R105E1-GS9-IL6R103C4, SEQ ID NO: 933

TABLE A-6-continued

Protein sequences of biparatopic anti-IL-6R Nanobodies
(IL6R-IL6 inhibiting block combined with a another
IL6R-IL6 inhibiting binding block)

EVQLVESGGGLVQAGGSLRLSCAASGSIFSIKAMGWYRQAPGKQRELVARITSGGSTY

YADSVKGRFTISRDNAKNTVYLQMNSLKPEDTAVFYCNAIVTDSDYDLGNDYWGQGTQ

VTVSSGGGGSGGGSEVQLVESGGGLVEAGGSLRLSCAAAGRTLSSYSMAWFRQAPGKE

REFVAIIRGNPSRTYHSDSVKGRFTASRDNAKNTVYLQMNRLEPEDTAVYYCAADPPP

FASDYSAPQSYDYWGQGTQVTVSS

IL6R120A5-GS35-IL6R100G11, SEQ ID NO: 934
EVQLVESGGGLVQAGGSLSLSCATSGRTISDDTMAWFRQAPGKEREFVAIITFNGART

HYSDSVRDRFTISRDNAKNTVYLQMNSLKSEDTAVYYCAASTKYYSSTYNYIHPAFYD

IWGQGTQVTVSSGGGGSGGGGSGGGGSGGGGSGGGGSGGGGSGGGGSEVQLVESGGGL

VQAGGSLRLSCAASGRGFSPYTMGWFRQAPGKERVFVAGISWSTGIAHYTDSVKGRFT

ISRDNAKNTGSLQMNSLKPEDTAVYYCAVVQTTKGNYDYWGQGTQVTVSS

IL6R120A5-GS35-IL6R120G6, SEQ ID NO: 935
EVQLVESGGGLVQAGGSLSLSCATSGRTISDDTMAWFRQAPGKEREFVAIITFNGART

HYSDSVRDRFTISRDNAKNTVYLQMNSLKSEDTAVYYCAASTKYYSSTYNYIHPAFYD

IWGQGTQVTVSSGGGGSGGGGSGGGGSGGGGSGGGGSGGGGSGGGGSEVQLVESGGDL

VQTGGSLRLSCAASGITVSDRAMGWYRQAPGKQREMVAGVSRGGMTSYADSVKGRLTI

SRDNAKNSVYLQMNSLNPEDTAVYYCSAYYRYGSSVPQYWGQGTQVTVSS

IL6R120A5-GS35-IL6R105E1, SEQ ID NO: 936
EVQLVESGGGLVQAGGSLSLSCATSGRTISDDTMAWFRQAPGKEREFVAIITFNGART

HYSDSVRDRFTISRDNAKNTVYLQMNSLKSEDTAVYYCAASTKYYSSTYNYIHPAFYD

IWGQGTQVTVSSGGGGSGGGGSGGGGSGGGGSGGGGSGGGGSGGGGSEVQLVESGGGL

VQAGGSLRLSCAASGSIFSIKAMGWYRQAPGKQRELVARITSGGSTYYADSVKGRFTI

SRDNAKNTVYLQMNSLKPEDTAVFYCNAIVTDSDYDLGNDYWGQGTQVTVSS

IL6R120A5-GS35-IL6R104B8, SEQ ID NO: 937
EVQLVESGGGLVQAGGSLSLSCATSGRTISDDTMAWFRQAPGKEREFVAIITFNGART

HYSDSVRDRFTISRDNAKNTVYLQMNSLKSEDTAVYYCAASTKYYSSTYNYIHPAFYD

IWGQGTQVTVSSGGGGSGGGGSGGGGSGGGGSGGGGSGGGGSGGGGSEVQLVESGGGL

VQAGGSLRLSCAASGFAFDDYAIGWFRQAPGKEREGVSSISSSNGNTYYADSVRGRFT

ISSDNAKNTVYLQMNSLKPEDTGVYYCAAIWGIFFNEKMPVGAYDYWGQGTQVTVSS

IL6R120A5-GS35-IL6R103C4, SEQ ID NO: 938
EVQLVESGGGLVQAGGSLSLSCATSGRTISDDTMAWFRQAPGKEREFVAIITFNGART

HYSDSVRDRFTISRDNAKNTVYLQMNSLKSEDTAVYYCAASTKYYSSTYNYIHPAFYD

IWGQGTQVTVSSGGGGSGGGGSGGGGSGGGGSGGGGSGGGGSGGGGSEVQLVESGGGL

VEAGGSLRLSCAAAGRTLSSYSMAWFRQAPGKEREFVAIIRGNPSRTYHSDSVKGRFT

ASRDNAKNTVYLQMNRLEPEDTAVYYCAADPPPFASDYSAPQSYDYWGQGTQVTVSS

IL6R120G6-GS35-IL6R100G11, SEQ ID NO: 939
EVQLVESGGDLVQTGGSLRLSCAASGITVSDRAMGWYRQAPGKQREMVAGVSRGGMTS

YADSVKGRLTISRDNAKNSVYLQMNSLNPEDTAVYYCSAYYRYGSSVPQYWGQGTQVT

VSSGGGGSGGGGSGGGGSGGGGSGGGGSGGGGSGGGGSEVQLVESGGGLVQAGGSLRL

SCAASGRGFSPYTMGWFRQAPGKERVFVAGISWSTGIAHYTDSVKGRFTISRDNAKNT

GSLQMNSLKPEDTAVYYCAVVQTTKGNYDYWGQGTQVTVSS

TABLE A-6-continued

Protein sequences of biparatopic anti-IL-6R Nanobodies
(IL6R-IL6 inhibiting block combined with a another
IL6R-IL6 inhibiting binding block)

IL6R120G6-GS35-IL6R105E1, SEQ ID NO: 940
EVQLVESGGDLVQTGGSLRLSCAASGITVSDRAMGWYRQAPGKQREMVAGVSRGGMTS

YADSVKGRLTISRDNAKNSVYLQMNSLNPEDTAVYYCSAYYRYGSSVPQYWGQGTQVT

VSSGGGGSGGGGSGGGGSGGGGSGGGGSGGGGSGGGGSEVQLVESGGGLVQAGGSLRL

SCAASGSIFSIKAMGWYRQAPGKQRELVARITSGGSTYYADSVKGRFTISRDNAKNT

VYLQMNSLKPEDTAVFYCNAIVTDSDYDLGNDYWGQGTQVTVSS

IL6R120G6-GS35-IL6R104B8, SEQ ID NO: 941
EVQLVESGGDLVQTGGSLRLSCAASGITVSDRAMGWYRQAPGKQREMVAGVSRGGMTS

YADSVKGRLTISRDNAKNSVYLQMNSLNPEDTAVYYCSAYYRYGSSVPQYWGQGTQVT

VSSGGGGSGGGGSGGGGSGGGGSGGGGSGGGGSGGGGSEVQLVESGGGLVQAGGSLRL

SCAASGFAFDDYAIGWFRQAPGKEREGVSSISSSNGNTYYADSVRGRFTISSDNAKNT

VYLQMNSLKPEDTGVYYCAAIWGIFFNEKMPVGAYDYWGQGTQVTVSS

IL6R120G6-GS35-IL6R103C4, SEQ ID NO: 942
EVQLVESGGDLVQTGGSLRLSCAASGITVSDRAMGWYRQAPGKQREMVAGVSRGGMTS

YADSVKGRLTISRDNAKNSVYLQMNSLNPEDTAVYYCSAYYRYGSSVPQYWGQGTQVT

VSSGGGGSGGGGSGGGGSGGGGSGGGGSGGGGSGGGGSEVQLVESGGGLVEAGGSLRL

SCAAAGRTLSSYSMAWFRQAPGKEREFVAIIRGNPSRTYHSDSVKGRFTASRDNAKNT

VYLQMNRLEPEDTAVYYCAADPPPFASDYSAPQSYDYWGQGTQVTVSS

IL6R105E1-GS35-IL6R100G11, SEQ ID NO: 943
EVQLVESGGGLVQAGGSLRLSCAASGSIFSIKAMGWYRQAPGKQRELVARITSGGSTY

YADSVKGRFTISRDNAKNTVYLQMNSLKPEDTAVFYCNAIVTDSDYDLGNDYWGQGTQ

VTVSSGGGGSGGGGSGGGGSGGGGSGGGGSGGGGSGGGGSEVQLVESGGGLVQAGGSL

RLSCAASGRGFSPYTMGWFRQAPGKERVFVAGISWSTGIAHYTDSVKGRFTISRDNAK

NTGSLQMNSLKPEDTAVYYCAVVQTTKGNYDYWGQGTQVTVSS

IL6R105E1-GS35-IL6R104B8, SEQ ID NO: 944
EVQLVESGGGLVQAGGSLRLSCAASGSIFSIKAMGWYRQAPGKQRELVARITSGGSTY

YADSVKGRFTISRDNAKNTVYLQMNSLKPEDTAVFYCNAIVTDSDYDLGNDYWGQGTQ

VTVSSGGGGSGGGGSGGGGSGGGGSGGGGSGGGGSGGGGSEVQLVESGGGLVQAGGS

LRLSCAASGFAFDDYAIGWFRQAPGKEREGVSSISSSNGNTYYADSVRGRFTISSDN

AKNTVYLQMNSLKPEDTGVYYCAAIWGIFFNEKMPVGAYDYWGQGTQVTVSS

IL6R105E1-GS35-IL6R103C4, SEQ ID NO: 945
EVQLVESGGGLVQAGGSLRLSCAASGSIFSIKAMGWYRQAPGKQRELVARITSGGST

YYADSVKGRFTISRDNAKNTVYLQMNSLKPEDTAVFYCNAIVTDSDYDLGNDYWGQG

TQVTVSSGGGGSGGGGSGGGGSGGGGSGGGGSGGGGSGGGGSEVQLVESGGGLVEAG

GSLRLSCAAAGRTLSSYSMAWFRQAPGKEREFVAIIRGNPSRTYHSDSVKGRFTASR

DNAKNTVYLQMNRLEPEDTAVYYCAADPPPFASDYSAPQSYDYWGQGTQVTVSS

TABLE A-7

Preferred, but non-limiting examples of albumin-binding Nanobodies

ALB-1, SEQ ID NO: 948
AVQLVESGGGLVQPGNSLRLSCAASGFTFRSFGMSWVRQAPGKEPEWVSS

ISGSGSDTLYADSVKGRFTISRDNAKTTLYLQMNSLKPEDTAVYYCTIGG

SLSRSSQGTQVTVSS

ALB-8 (humanized ALB-1), SEQ ID NO: 949
EVQLVESGGGLVQPGNSLRLSCAASGFTFSSFGMSWVRQAPGKGLEWVSS

ISGSGSDTLYADSVKGRFTISRDNAKTTLYLQMNSLRPEDTAVYYCTIGG

SLSRSSQGTLVTVSS

ALB-2, SEQ ID NO: 950
AVQLVESGGGLVQGGGSLRLACAASERIFDLNLMGWYRQGPGNERELVAT

CITVGDSTNYADSVKGRFTISMDYTKQTVYLHMNSLRPEDTGLYYCKIRR

TWHSELWGQGTQVTVSS

TABLE A-8

Sequences of possible linkers

GS35, SEQ ID NO: 951
GGGGSGGGGSGGGGSGGGGSGGGGSGGGGSGGGGS
GS30, SEQ ID NO: 952
GGGGSGGGGSGGGGSGGGGSGGGGSGGGGS
GS15, SEQ ID NO: 953
GGGGSGGGGSGGGGS
GS9, SEQ ID NO: 954
GGGGSGGGS
GS7, SEQ ID NO: 955
SGGSGGS
Llama upper long hinge region, SEQ ID NO: 956
EPKTPEKPQPAAA

TABLE C-2

Size and percentages of inserts of constructed libraries

|  | Library size | % insert |
|---|---|---|
| 128b-PBL2 + 3 + LN | 7E6 | 91 |
| 129b-PBL2 + 3 + LN | 8E6 | 91 |
| 129b-PBL1 | 2E7 | 91 |
| 130b-PBL2 + 3 + LN | 7E6 | 91 |

TABLE C-3

Experimental conditions used in different selection strategies

| Method | immobilization/ capture | Antigen | Concentration/ amount | Elution |
|---|---|---|---|---|
| Plate | BN-12 | IL-6R (Peprotech) | 0, 100 nM | Trypsin (100 nM) |
| Plate | BN-12 | IL-6R (Peprotech) | 0, 100 nM | Ref IgG (100 nM) |
| Plate | Direct coating of the antigen | IL-6R (Peprotech) | 0, 100 nM | Trypsin (100 nM) |
| Magnetic beads | Streptavidin | bio-IL-6R | 0, 10, 100 nM | Trypsin (100 nM) |
| Magnetic beads | Streptavidin | bio-IL-6R | 0, 10, 100 nM | IL6R300 (100 nM) |

TABLE C-4

Results of screening for Nanobodies that inhibit the IL-6/IL-6R interaction

| Assay | # clones screened | # inhibitors (%) |
|---|---|---|
| IL-6/IL-6R | 1744 | 327 (18.7%) |

TABLE C-1

Immunization protocol

| Day | Llama 128b | Llama 129b | Llama 130b | Tissue collection |
|---|---|---|---|---|
| 0 | 5E7 frozen cells | 5E7 frozen cells | 5E7 frozen cells | 10 ml pre-immune blood |
|  |  |  |  | 50 ml pre-immune blood (NC0) |
| 14 | 2E7 frozen cells | 2E7 frozen cells | 2E7 frozen cells | 10 ml immune blood |
| 28 | 2E7 frozen cells | 2E7 frozen cells | 2E7 frozen cells | 10 ml immune blood |
|  |  |  |  | 150 ml immune blood (PBL1) |
| 35 |  |  |  | 10 ml immune blood |
| 44 | 2E7 frozen cells | 2E7 frozen cells | 2E7 frozen cells | 10 ml immune blood |
| 49 |  |  |  | 150 ml immune blood (PBL2) |
|  |  |  |  | 10 ml immune blood |
|  |  |  |  | lymph node bow biopsy |
| 53 |  |  |  | 150 ml immune blood (PBL3) |
|  |  |  |  | 10 ml immune blood |
| 56 |  | — | — | 100 ml immune blood (NC1) |
| 58 | — |  |  | 100 ml immune blood (NC1) |
| 88 | 25 µg hIL6R | 25 µg hIL6R | 25 µg hIL6R | — |
| 92 |  |  |  | 150 ml immune blood (PBL4) |
|  |  |  |  | 10 ml immune blood |
| 99 |  |  |  | 100 ml immune blood (NC2) |
|  |  |  |  | 10 ml immune blood |

TABLE C-5

Potency ELISA

| Clone | Family | ELISA 1 | ELISA 2 | ELISA 3 |
| --- | --- | --- | --- | --- |
| PMP108D2 | 20 | 0.06242 | 0.34523 | 0.91642 |
| PMP101F6 | 7 | 0.07025 | 0.02726 | 0.94682 |
| PMP108E01 | 20 | 0.08939 | 0.35936 | 0.95376 |
| PMP101D2 | 3 | 0.12402 | 0.82169 | 0.97744 |
| PMP101B6 | 7 | 0.13356 | 0.03521 | 0.96132 |
| PMP120A5 | 28 | 0.13802 | 0.031 | 0.98831 |
| PMP120C10 | 28 | 0.13927 | 0.03513 | 1.00663 |
| PMP101G1 | 2 | 0.14831 | 0.0937 | 0.6386 |
| PMP105E1 | 7 | 0.2102 | 0.04016 | 0.99467 |
| PMP107A1 | 11 | 0.21525 | 0.29157 | 0.96721 |
| PMP101G11 | 2 | 0.22702 | 0.05382 | 0.46803 |
| PMP101B6 | 7 | 0.23543 | 0.05221 | 0.97746 |
| PMP120G6 | 93 | 0.23588 | 0.02893 | 0.99299 |
| PMP103D7 | 19 | 0.35456 | 0.08207 | 0.97994 |
| PMP101B3 | 6 | 0.40243 | 1.04997 | 0.9718 |
| PMP103C7 | 28 | 0.41323 | 0.17484 | 0.94776 |
| PMP107C3 | 11 | 0.43762 | 0.90376 | 1.05554 |
| PMP105D3 | 6 | 0.45717 | 0.99514 | 1.01409 |
| PMP120F4 | 86 | 0.49812 | 0.03307 | 0.92323 |
| PMP101A1 | 8 | 0.50824 | 0.52129 | 0.98912 |
| PMP107G10 | 11 | 0.52328 | 0.88303 | 1.0145 |
| PMP106F04 | 6 | 0.5568 | 1.1871 | 1.00588 |
| PMP120C1 | 28 | 0.56713 | 0.18668 | 1.01949 |
| PMP101F2 | 3 | 0.56895 | 0.81147 | 0.9718 |
| PMP105C2 | 6 | 0.57728 | 1.00665 | 0.99644 |
| PMP101C3 | 3 | 0.58023 | 0.80068 | 0.97542 |
| PMP107E4 | 11 | 0.59218 | 1.1894 | 1.02148 |
| PMP101G2 | 6 | 0.5967 | 1.04373 | 0.97542 |
| PMP120A1 | 28 | 0.59849 | 0.1977 | 1.01208 |
| PMP105H10 | 3 | 0.62663 | 0.67878 | 1.02435 |
| PMP120B2 | 28 | 0.64492 | 0.2039 | 1.01676 |
| PMP120D2 | 28 | 0.65872 | 0.15844 | 0.99299 |
| PMP106F7 | 6 | 0.67225 | 1.00205 | 1.00137 |
| PMP120C11 | 28 | 0.67252 | 0.29552 | 0.98753 |
| PMP105E11 | 3 | 0.67915 | 0.69135 | 0.97075 |
| PMP120B7 | 28 | 0.71393 | 0.29897 | 1.02767 |
| PMP101E1 | 3 | 0.71552 | 0.80466 | 0.94722 |
| PMP108E9 | 15 | 0.73091 | 0.96058 | 0.98947 |
| PMP100A10 | 4 | 0.74782 | 0.18912 | 0.96991 |
| PMP101F1 | 3 | 0.75369 | 0.82851 | 0.95689 |
| PMP101F3 | 3 | 0.75802 | 0.82169 | 0.98388 |
| PMP101H3 | 3 | 0.7719 | 0.85917 | 0.95407 |
| PMP101H6 | 5 | 0.78751 | 0.71323 | 0.95407 |
| PMP101A4 | 8 | 0.79185 | 0.71266 | 0.98993 |
| PMP101G4 | 3 | 0.79618 | 0.81488 | 1.02417 |
| PMP105B8 | 3 | 0.80819 | 0.81623 | 1.02927 |
| PMP101D1 | 5 | 0.8118 | 0.78989 | 0.92788 |
| PMP107H2 | 27 | 0.86499 | 0.59969 | 0.96156 |
| PMP108D1 | 5 | 0.86965 | 0.79012 | 1.03584 |
| PMP119A10 | 13 | 0.87704 | 0.24868 | 0.9887 |
| PMP107H5 | 11 | 0.9013 | 0.99744 | 1.03133 |
| PMP108C9 | 16 | 0.91061 | 0.90683 | 1.00917 |
| PMP100A6 | 9 | 0.94796 | 0.72232 | 0.92305 |
| PMP103C4 | 19 | 0.95852 | 0.08193 | 1.00246 |
| PMP108D10 | 5 | 0.96089 | 0.76094 | 1.02558 |
| PMP106B2 | 6 | 0.99047 | 1.01526 | 0.98361 |
| PMP101A5 | 5 | 1.02949 | 0.73595 | 0.95044 |
| PMP101C2 | 5 | 1.0399 | 1.02669 | 0.95205 |
| PMP103A4 | 12 | 1.04004 | 0.91605 | 1.02517 |
| PMP108F7 | 5 | 1.04935 | 0.8001 | 1.0186 |
| PMP108C10 | 5 | 1.07076 | 0.79473 | 1.04323 |
| PMP101A3 | 5 | 1.07546 | 0.68654 | 0.94601 |
| PMP101G3 | 5 | 1.07979 | 0.77286 | 0.89202 |
| PMP107A9 | 21 | 1.08464 | 0.08675 | 0.99221 |
| PMP101D6 | 5 | 1.09107 | 0.73083 | 0.94762 |
| PMP101B2 | 5 | 1.0928 | 0.72743 | 0.90894 |
| PMP107B04 | 17 | 1.20484 | 0.91835 | 1.04118 |
| PMP106D06 | 22 | 1.2713 | 1.13173 | 1.0041 |
| PMP104E04 | 8 | 1.3352 | 0.83775 | 1.02951 |
| PMP104B08 | 3 | 1.463 | 0.73494 | 1.05287 |
| PMP103H09 | 13 | 1.58744 | 0.26265 | 0.99016 |
| PMP100G11 | 4 | 1.70684 | 0.20241 | 0.99672 |
| PMP102G3 | 11a | 1.75561 | 1.3245 | 0.96762 |
| PMP103B2 | 25 | 1.76401 | 0.80964 | 1.01885 |
| PMP100D11 | 9 | 1.89686 | 0.96225 | 0.96926 |
| PMP103F2 | 26 | 1.94563 | 1.09398 | 0.99344 |
| PMP103C3 | 14 | 2.01962 | 1.1004 | 1.00574 |
| PMP103A2 | 12 | 2.04148 | 1.08996 | 0.99303 |
| PMP104A08 | 5 | 2.04148 | 0.7253 | 0.97254 |
| PMP104E07 | 18 | 2.04148 | 0.99277 | 1.00984 |
| PMP104B9 | 5 | 2.0583 | 0.76627 | 0.99959 |
| PMP103A5 | 24 | 2.12052 | 0.85944 | 0.94262 |

TABLE C-6 koff rates for periplasmic extracts of selected clones as measured in Biacore

| Clone | family | $k_{off}$ rate human | $k_{off}$ rate cyno |
| --- | --- | --- | --- |
| PMP101G11 | 2 | 4.20E-04 | inaccurate value |
| PMP104B8 | 3 | 1.00E-02 | 1.00E-02 |
| PMP105B8 | 3 | 1.00E-02 | 1.00E-02 |
| PMP105H10 | 3 | 1.00E-02 | 1.00E-02 |
| PMP100G11 | 4 | 2.70E-04 | 4.50E-04 |
| PMP104A8 | 5 | 8.50E-04 | 1.00E-03 |
| PMP104B9 | 5 | 2.30E-04 | 7.40E-04 |
| PMP108C10 | 5 | 6.80E-03 | 7.10E-04 |
| PMP108D1 | 5 | 6.60E-03 | 7.90E-04 |
| PMP108D10 | 5 | 9.40E-04 | 9.00E-04 |
| PMP108F07 | 5 | 1.00E-03 | 7.40E-04 |
| PMP101A5 | 5 | 2.70E-04 | 4.50E-04 |
| PMP101H6 | 5 | 1.10E-04 | 1.00E-04 |
| PMP105C2 | 6 | 1.00E-02 | no binding |
| PMP105D3 | 6 | 1.00E-02 | no binding |
| PMP106B2 | 6 | 1.00E-02 | no binding |
| PMP106F7 | 6 | 1.00E-02 | no binding |
| PMP105E01 | 7 | 4.10E-04 | 1.00E-03 |
| PMP101B6 | 7 | 5.80E-04 | 1.00E-03 |
| PMP104E4 | 8 | 7.50E-04 | 4.50E-04 |
| PMP100D11 | 9 | 1.20E-04 | 7.40E-04 |
| PMP107E4 | 11a | 1.00E-02 | no binding |
| PMP107G10 | 11a | ND | no binding |
| PMP107A1 | 11b | 7.50E-04 | 1.00E-02 |
| PMP107C3 | 11b | ND | no binding |
| PMP107H5 | 11b | 1.00E-03 | no binding |
| PMP103A2 | 12 | 9.50E-04 | 1.00E-03 |
| PMP103A4 | 12 | 1.40E-03 | 4.50E-04 |
| PMP103H9 | 13 | 1.00E-02 | 1.00E-02 |
| PMP103C3 | 14 | no binding | no binding |
| PMP108E9 | 15 | no binding | no binding |
| PMP108C9 | 16 | no binding | no binding |
| PMP107B4 | 17 | 1.00E-02 | 1.00E-02 |
| PMP104E7 | 18 | 1.00E-03 | no binding |
| PMP103C4 | 19 | 1.00E-03 | 1.00E-03 |
| PMP108E1 | 20 | 1.00E-04 | 1.00E-03 |
| PMP107A9 | 21 | 1.00E-02 | 1.00E-02 |
| PMP106D6 | 22 | 1.00E-03 | no binding |
| PMP103A5 | 24 | 3.90E-04 | 7.40E-04 |
| PMP103B2 | 25 | 1.00E-03 | 4.50E-04 |
| PMP103F2 | 26 | no binding | no binding |
| PMP107H2 | 27 | 1.00E-04 | ND |
| PMP120A5 | 28 | ND | ND |
| PMP120F4 | 86 | ND | ND |
| PMP120C5 | 87 | ND | ND |
| PMP120G11 | 89 | ND | ND |
| PMP120H6 | 92 | ND | ND |
| PMP120G6 | 93 | ND | ND |

TABLE C-7

Epitope mapping

| clone | family | binding to human IL6-R | binding to hybrid IL6-R |
|---|---|---|---|
| PMP101H6 | 5 | yes | yes |
| PMP107H2 | 27 | yes | yes |
| PMP103A4 | 12 | yes | yes |
| PMP108E5 | 20 | yes | yes |
| PMP107A1 | 11 | yes | yes |
| PMP100G11 | 4 | yes | yes |
| PMP101B12 | 2 | yes | no |
| PMP104E4 | 8 | yes | no |
| PMP103B2 | 25 | yes | no |
| PMP100D11 | 9 | yes | no |
| PMP103A5 | 24 | yes | no |

TABLE C-8

IC50 values of monovalent wild type Nanobodies obtained in TF-1 assay

| clone | family | IC50 (nM) |
|---|---|---|
| PMP105E1 | 7 | 6.2 |
| PMP120A5 | 28 | 5.59 |
| PMP108E1 | 20 | 0.149 |
| PMP107A1 | 11 | 4.05 |
| PMP107A9 | 21 | 349 |
| PMP103H9 | 13 | 1470 |
| PMP103C4 | 19 | 15.56 |
| PMP120G6 | 93 | 10.23 |
| PMP103C7 | 28 | 61.26 |
| PMP100G11 | 4 | 115.8 |
| PMP104B8 | 3 | 244.7 |
| Ref IgG | | 0.53 |

TABLE C-9

IC50 values in potency ELISA obtained for monovalent wild type Nanobodies

| clone | family | IC50 on human plasma (nM) | IC50 on cynomolgous plasma (nM) |
|---|---|---|---|
| PMP105E1 | 7 | 0.58 | 0.62 |
| PMP120A5 | 28 | 0.47 | 0.55 |
| PMP108E1 | 20 | 0.15 | 29.1 |
| PMP107A1 | 11 | 0.38 | 47.8 |
| PMP107A9 | 21 | 3.5 | 4.7 |
| PMP103H9 | 13 | 37.9 | 14.8 |
| PMP103C4 | 19 | 1.73 | 2.7 |
| PMP120G6 | 93 | 1.12 | 0.66 |
| PMP103C7 | 28 | 6.9 | 13.7 |
| PMP104B8 | 3 | 7.8 | 252 |

TABLE C-10

Overview of $k_d/k_{off}$, $k_a$-, and $K_d$-values for a selected subset of 7 anti-IL-6R Nanobodies

| Clone | $k_d/k_{off}(s^{-1})$ | $k_a$ (1/Ms) | $K_d$ (nM) |
|---|---|---|---|
| PMP120A5 | | | |
| PMP105E1 | | | |
| PMP120G6 | | | |
| PMP101H6 | | | |
| PMP100G11 | | | |
| PMP104E4 | | | |
| PMP103A4 | | | |

TABLE C-11

Inhibition of the Reference-Fab/IL-6R interaction by 14 selected inhibitory anti-IL-6R Nanobodies

| clone | family | IC50 on CHO K1-human IL-6R (nM) | IC50 on CHO K1-cynomolgous IL-6R(nM) |
|---|---|---|---|
| PMP105E1 | 7 | >100 | 13 |
| PMP120A5 | 28 | 63 | 27 |
| PMP108E1 | 20 | No competition | No competition |
| PMP107A1 | 11 | No competition | No competition |
| PMP101B12 | 2 | No competition | No competition |
| PMP103H9 | 13 | >50 | No accurate value |
| PMP103C4 | 19 | 37 | 30 |
| PMP120G6 | 93 | No competition | No competition |
| PMP103C7 | 28 | >100 | 75 |
| PMP100G11 | 4 | No competition | No competition |
| PMP104B8 | 3 | No competition | No competition |
| Ref Fab | | 3.40 | 0.80 |

TABLE C-12

Design of biparatopic anti-IL-6R Nanobodies

| Nanobody ID | design |
|---|---|
| IL6R0402 | PMP101H6-35GS-PMP105E1 |
| IL6R0401 | PMP101B12-35GS-PMP105E1 |

SEQUENCE LISTING (956 sequences)

SEQ ID NO: 1 - protein, 102 aa, Artificial Sequence
  KERE-class Nanobody
  misc_feature (31)..(35): Xaa is any amino acid
  misc_feature (50)..(54): Xaa is any amino acid
  misc_feature (87)..(91): Xaa is any amino acid
EVQLVESGGGLVQPGGSLRLSCAASGIPFSXXXXXWFRQAPGKQRDSVAXXXXXRFTISRDNAKNTVYLQMNSLKPEDTAVYRCYFXXXXXWGQGTQVTVSS

SEQ ID NO: 2 - protein, 102 aa, Artificial Sequence
  KERE-class Nanobody
  misc_feature (31)..(35): Xaa is any amino acid
  misc_feature (50)..(54): Xaa is any amino acid
  misc_feature (87)..(91): Xaa is any amino acid
QVKLEESGGGLVQAGGSLRLSCVGSGRTFSXXXXXWFRLAPGKEREFVAXXXXXRFTISRDTASNRGYLHMNNLTPEDTAVYYCAAXXXXXWGQGTQVTVSS

SEQ ID NO: 3 - protein, 102 aa, Artificial Sequence
  KERE-class Nanobody
  misc_feature (31)..(35): Xaa is any amino acid
  misc_feature (50)..(54): Xaa is any amino acid
  misc_feature (87)..(91): Xaa is any amino acid
AVQLVDSGGGLVQAGDSLKLSCALTGGAFTXXXXXWFRQTPGREREFVAXXXXXRFTISRDNAKNMVYLRMNSLIPEDAAVYSCAAXXXXXWGQGTLVTVSS

SEQ ID NO: 4 - protein, 102 aa, Artificial Sequence
  KERE-class Nanobody
  misc_feature (31)..(35): Xaa is any amino acid
  misc_feature (50)..(54): Xaa is any amino acid
  misc_feature (87)..(91): Xaa is any amino acid
QVQLVESGGGLVEAGGSLRLSCTASESPFRXXXXXWFRQTSGQEREFVAXXXXXRFTISRDDAKNTVWLHGSTLKPEDTAVYYCAAXXXXXWGQGTQVTVSS

SEQ ID NO: 5 - protein, 102 aa, Artificial Sequence
  KERE-class Nanobody
  misc_feature (31)..(35): Xaa is any amino acid
  misc_feature (50)..(54): Xaa is any amino acid
  misc_feature (87)..(91): Xaa is any amino acid
AVQLVESGGGLVQGGGSLRLACAASERIFDXXXXXWYRQGPGNERELVAXXXXXRFTISMDYTKQTVYLHMNSLRPEDTGLYYCKIXXXXXWGQGTQVTVSS

SEQ ID NO: 6 - protein, 102 aa, Artificial Sequence
  KERE-class Nanobody
  misc_feature (31)..(35): Xaa is any amino acid
  misc_feature (50)..(54): Xaa is any amino acid
  misc_feature (87)..(91): Xaa is any amino acid
DVKFVESGGGLVQAGGSLRLSCVASGFNFDXXXXXWFRQAPGKEREEVAXXXXXRFTISSEKDKNSVYLQMNSLKPEDTALYICAGXXXXXWGRGTQVTVSS

SEQ ID NO: 7 - protein, 102 aa, Artificial Sequence
  KERE-class Nanobody
  misc_feature (31)..(35): Xaa is any amino acid
  misc_feature (50)..(54): Xaa is any amino acid
  misc_feature (87)..(91): Xaa is any amino acid
QVRLAESGGGLVQSGGSLRLSCVASGSTYTXXXXXWYRQYPGKQRALVAXXXXXRFTIARDSTKDTFCLQMNNLKPEDTAVYYCYAXXXXXWGQGTQVTVSS

SEQ ID NO: 8 - protein, 102 aa, Artificial Sequence
  KERE-class Nanobody
  misc_feature (31)..(35): Xaa is any amino acid
  misc_feature (50)..(54): Xaa is any amino acid
  misc_feature (87)..(91): Xaa is any amino acid
EVQLVESGGGLVQAGGSLRLSCAASGFTSDXXXXXWFRQAPGKPREGVSXXXXXRFTISTDNAKNTVHLLMNRVNAEDTALYYCAVXXXXXWGRGTRVTVSS

SEQ ID NO: 9 - protein, 102 aa, Artificial Sequence
  KERE-class Nanobody
  misc_feature (31)..(35): Xaa is any amino acid
  misc_feature (50)..(54): Xaa is any amino acid
  misc_feature (87)..(91): Xaa is any amino acid
QVQLVESGGGLVQPGGSLRLSCQASGDISTXXXXXWYRQVPGKLREFVAXXXXXRFTISGDNAKRAIYLQMNNLKPDDTAVYYCNRXXXXXWGQGTQVTVSP

SEQ ID NO: 10 - protein, 102 aa, Artificial Sequence
  KERE-class Nanobody
  misc_feature (31)..(35): Xaa is any amino acid
  misc_feature (50)..(54): Xaa is any amino acid
  misc_feature (87)..(91): Xaa is any amino acid
QVPVVESGGGLVQAGDSLRLFCAVPSFTSTXXXXXWFRQAPGKEREFVAXXXXXRFTISRNATKNTLTLRMDSLKPEDTAVYYCAAXXXXXWGQGTQVTVSS

SEQ ID NO: 11 - protein, 102 aa, Artificial Sequence
  KERE-class Nanobody
  misc_feature (31)..(35): Xaa is any amino acid
  misc_feature (50)..(54): Xaa is any amino acid
  misc_feature (87)..(91): Xaa is any amino acid
EVQLVESGGGLVQAGDSLRLFCTVSGGTASXXXXXWFRQAPGEKREFVAXXXXXRFTIARENAGNMVYLQMNNLKPDDTALYTCAAXXXXXWGRGTQVTVSS

SEQ ID NO: 12 - protein, 102 aa, Artificial Sequence
  KERE-class Nanobody
  misc_feature (31)..(35): Xaa is any amino acid
  misc_feature (50)..(54): Xaa is any amino acid
  misc_feature (87)..(91): Xaa is any amino acid
AVQLVESGGDSVQPGDSQTLSCAASGRTNSXXXXXWFRQAPGKERVFLAXXXXXRFTISRDSAKNMMYLQMNNLKPQDTAVYYCAAXXXXXWGQGTQVTVSS

SEQ ID NO: 13 - protein, 102 aa, Artificial Sequence
  KERE-class Nanobody
  misc_feature (31)..(35): Xaa is any amino acid
  misc_feature (50)..(54): Xaa is any amino acid
  misc_feature (87)..(91): Xaa is any amino acid
AVQLVESGGGLVQAGGSLRLSCVVSGLTSSXXXXXWFRQTPWQERDFVAXXXXXRFTISRDNYKDTVLLEMNFLKPEDTAIYYCAAXXXXXWGQGTQVTVSS

SEQ ID NO: 14 - protein, 102 aa, Artificial Sequence
  KERE-class Nanobody
  misc_feature (31)..(35): Xaa is any amino acid
  misc_feature (50)..(54): Xaa is any amino acid
  misc_feature (87)..(91): Xaa is any amino acid
AVQLVESGGGLVQAGASLRLSCATSTRTLDXXXXXWFRQAPGRDREFVAXXXXXRFTVSRDSAENTVALQMNSLKPEDTAVYYCAAXXXXXWGQGTRVTVSS

SEQ ID NO: 15 - protein, 102 aa, Artificial Sequence
  KERE-class Nanobody
  misc_feature (31)..(35): Xaa is any amino acid
  misc_feature (50)..(54): Xaa is any amino acid
  misc_feature (87)..(91): Xaa is any amino acid
QVQLVESGGGLVQPGGSLRLSCTVSRLTAHXXXXXWFRQAPGKEREAVSXXXXXRFTISRDYAGNTAFLQMDSLKPEDTGVYYCATXXXXXWGQGTQVTVSS

SEQ ID NO: 16 - protein, 102 aa, Artificial Sequence
  KERE-class Nanobody
  misc_feature (31)..(35): Xaa is any amino acid
  misc_feature (50)..(54): Xaa is any amino acid
  misc_feature (87)..(91): Xaa is any amino acid
EVQLVESGGELVQAGGSLKLSCTASGRNFVXXXXXWFRRAPGKEREFVAXXXXXRFTVSRDNGKNTAYLRMNSLKPEDTADYYCAVXXXXXLGSGTQVTVSS

SEQ ID NO: 17 - protein, 102 aa, Artificial Sequence
  GLEW-class Nanobody
  misc_feature (31)..(35): Xaa is any amino acid
  misc_feature (50)..(54): Xaa is any amino acid
  misc_feature (87)..(91): Xaa is any amino acid
AVQLVESGGGLVQPGGSLRLSCAASGFTFSXXXXXWVRQAPGKVLEWVSXXXXXRFTISRDNAKNTLYLQMNSLKPEDTAVYYCVKXXXXXGSQGTQVTVSS

SEQ ID NO: 18 - protein, 102 aa, Artificial Sequence
  GLEW-class Nanobody
  misc_feature (31)..(35): Xaa is any amino acid
  misc_feature (50)..(54): Xaa is any amino acid
  misc_feature (87)..(91): Xaa is any amino acid
EVQLVESGGGLVQPGGSLRLSCVCVSSGCTXXXXXWVRQAPGKAEEWVSXXXXXRFKISRDNAKKTLYLQMNSLGPEDTAMYYCQRXXXXXRGQGTQVTVSS

SEQ ID NO: 19 - protein, 102 aa, Artificial Sequence
  GLEW-class Nanobody
  misc_feature (31)..(35): Xaa is any amino acid
  misc_feature (50)..(54): Xaa is any amino acid
  misc_feature (87)..(91): Xaa is any amino acid
EVQLVESGGGLALPGGSLTLSCVFSGSTFSXXXXXWVRHTPGKAEEWVSXXXXXRFTISRDNAKNTLYLEMNSLSPEDTAMYYCGRXXXXXRSKGIQVTVSS

SEQ ID NO: 20 - protein, 102 aa, Artificial Sequence
  P,R,S 103-class Nanobody
  misc_feature (31)..(35): Xaa is any amino acid
  misc_feature (50)..(54): Xaa is any amino acid
  misc_feature (87)..(91): Xaa is any amino acid
AVQLVESGGGLVQAGGSLRLSCAASGRTFSXXXXXWFRQAPGKEREFVAXXXXXRFTISRDNAKNTVYLQMNSLKPEDTAVYYCAAXXXXXRGQGTQVTVSS

SEQ ID NO: 21 - protein, 102 aa, Artificial Sequence
  P,R,S 103-class Nanobody
  misc_feature (31)..(35): Xaa is any amino acid
  misc_feature (50)..(54): Xaa is any amino acid
  misc_feature (87)..(91): Xaa is any amino acid
DVQLVESGGDLVQPGGSLRLSCAASGFSFDXXXXXWLRQTPGKGLEWVGXXXXXRFTISRDNAKNMLYLHLNNLKSEDTAVYYCRRXXXXXLGQGTQVTVSS

SEQ ID NO: 22 - protein, 102 aa, Artificial Sequence; identical to SEQ ID NO: 18
  P,R,S 103-class Nanobody
  misc_feature (31)..(35): Xaa is any amino acid
  misc_feature (50)..(54): Xaa is any amino acid
  misc_feature (87)..(91): Xaa is any amino acid

SEQ ID NO: 23 - protein, 30 aa, Artificial Sequence
  KERE-class Nanobody FW1 sequence
QVQRVESGGGLVQAGGSLRLSCAASGRTSS

SEQ ID NO: 24 - protein, 30 aa, Artificial Sequence
  KERE-class Nanobody FW1 sequence
QVQLVESGGGLVQTGDSLSLSCSASGRTFS

SEQ ID NO: 25 - protein, 30 aa, Artificial Sequence
  KERE-class Nanobody FW1 sequence
QVKLEESGGGLVQAGDSLRLSCAATGRAFG

SEQ ID NO: 26 - protein, 30 aa, Artificial Sequence
  KERE-class Nanobody FW1 sequence
AVQLVESGGGLVQPGESLGLSCVASGRDFV

SEQ ID NO: 27 - protein, 30 aa, Artificial Sequence
  KERE-class Nanobody FW1 sequence
EVQLVESGGGLVQAGGSLRLSCEVLGRTAG

SEQ ID NO: 28 - protein, 30 aa, Artificial Sequence
  KERE-class Nanobody FW1 sequence
QVQLVESGGGWVQPGGSLRLSCAASETILS

SEQ ID NO: 29 - protein, 30 aa, Artificial Sequence
  KERE-class Nanobody FW1 sequence
QVQLVESGGGTVQPGGSLNLSCVASGNTFN

SEQ ID NO: 30 - protein, 30 aa, Artificial Sequence
  KERE-class Nanobody FW1 sequence
EVQLVESGGGLAQPGGSLQLSCSAPGFTLD

SEQ ID NO: 31 - protein, 30 aa, Artificial Sequence
  KERE-class Nanobody FW1 sequence
AQELEESGGGLVQAGGSLRLSCAASGRTFN

SEQ ID NO: 32 - protein, 22 aa, Artificial Sequence
  KERE-class Nanobody FW1 sequence
VESGGGLVQPGGSLRLSCAASG

SEQ ID NO: 33 - protein, 22 aa, Artificial Sequence
  KERE-class Nanobody FW1 sequence
VDSGGGLVQAGDSLKLSCALTG

SEQ ID NO: 34 - protein, 22 aa, Artificial Sequence
  KERE-class Nanobody FW1 sequence
VDSGGGLVQAGDSLRLSCAASG

SEQ ID NO: 35 - protein, 22 aa, Artificial Sequence
  KERE-class Nanobody FW1 sequence
VDSGGGLVEAGGSLRLSCQVSE

SEQ ID NO: 36 - protein, 22 aa, Artificial Sequence
  KERE-class Nanobody FW1 sequence
QDSGGGSVQAGGSLKLSCAASG

SEQ ID NO: 37 - protein, 22 aa, Artificial Sequence
  KERE-class Nanobody FW1 sequence
VQSGGRLVQAGDSLRLSCAASE

SEQ ID NO: 38 - protein, 22 aa, Artificial Sequence
  KERE-class Nanobody FW1 sequence
VESGGTLVQSGDSLKLSCASST

SEQ ID NO: 39 - protein, 22 aa, Artificial Sequence
  KERE-class Nanobody FW1 sequence
MESGGDSVQSGGSLTLSCVASG

SEQ ID NO: 40 - protein, 22 aa, Artificial Sequence
  KERE-class Nanobody FW1 sequence
QASGGGLVQAGGSLRLSCSASV

SEQ ID NO: 41 - protein, 14 aa, Artificial Sequence
  KERE-class Nanobody FW2 sequence
WFRQAPGKEREFVA

SEQ ID NO: 42 - protein, 14 aa, Artificial Sequence
  KERE-class Nanobody FW2 sequence
WFRQTPGREREFVA

SEQ ID NO: 43 - protein, 14 aa, Artificial Sequence
  KERE-class Nanobody FW2 sequence
WYRQAPGKQREMVA

SEQ ID NO: 44 - protein, 14 aa, Artificial Sequence
  KERE-class Nanobody FW2 sequence
WYRQGPGKQRELVA

SEQ ID NO: 45 - protein, 14 aa, Artificial Sequence
  KERE-class Nanobody FW2 sequence
WIRQAPGKEREGVS

SEQ ID NO: 46 - protein, 14 aa, Artificial Sequence
  KERE-class Nanobody FW2 sequence
WFREAPGKEREGIS

SEQ ID NO: 47 - protein, 14 aa, Artificial Sequence
  KERE-class Nanobody FW2 sequence
WYRQAPGKERDLVA

SEQ ID NO: 48 - protein, 14 aa, Artificial Sequence
  KERE-class Nanobody FW2 sequence
WFRQAPGKQREEVS

SEQ ID NO: 49 - protein, 14 aa, Artificial Sequence
  KERE-class Nanobody FW2 sequence
WFRQPPGKVREFVG

SEQ ID NO: 50 - protein, 32 aa, Artificial Sequence
  KERE-class Nanobody FW3 sequence
RFTISRDNAKNTVYLQMNSLKPEDTAVYRCYF

SEQ ID NO: 51 - protein, 32 aa, Artificial Sequence
  KERE-class Nanobody FW3 sequence
RFAISRDNNKNTGYLQMNSLEPEDTAVYYCAA

SEQ ID NO: 52 - protein, 32 aa, Artificial Sequence
  KERE-class Nanobody FW3 sequence
RFTVARNNAKNTVNLEMNSLKPEDTAVYYCAA

SEQ ID NO: 53 - protein, 32 aa, Artificial Sequence
  KERE-class Nanobody FW3 sequence
RFTISRDIAKNTVDLLMNNLEPEDTAVYYCAA

SEQ ID NO: 54 - protein, 32 aa, Artificial Sequence
  KERE-class Nanobody FW3 sequence
RLTISRDNAVDTMYLQMNSLKPEDTAVYYCAA

SEQ ID NO: 55 - protein, 32 aa, Artificial Sequence
  KERE-class Nanobody FW3 sequence
RFTISRDNAKNTVYLQMDNVKPEDTAIYYCAA

SEQ ID NO: 56 - protein, 32 aa, Artificial Sequence
  KERE-class Nanobody FW3 sequence
RFTISKDSGKNTVYLQMTSLKPEDTAVYYCAT

SEQ ID NO: 57 - protein, 32 aa, Artificial Sequence
  KERE-class Nanobody FW3 sequence
RFTISRDSAKNMMYLQMNNLKPQDTAVYYCAA

SEQ ID NO: 58 - protein, 32 aa, Artificial Sequence
  KERE-class Nanobody FW3 sequence
RFTISRENDKSTVYLQLNSLKPEDTAVYYCAA

SEQ ID NO: 59 - protein, 32 aa, Artificial Sequence
  KERE-class Nanobody FW3 sequence
RFTISRDYAGNTAYLQMNSLKPEDTGVYYCAT

SEQ ID NO: 60 - protein, 11 aa, Artificial Sequence
  KERE-class Nanobody FW4 sequence
WGQGTQVTVSS

SEQ ID NO: 61 - protein, 11 aa, Artificial Sequence
  KERE-class Nanobody FW4 sequence
WGKGTLVTVSS

SEQ ID NO: 62 - protein, 11 aa, Artificial Sequence
  KERE-class Nanobody FW4 sequence
RGQGTRVTVSS

SEQ ID NO: 63 - protein, 11 aa, Artificial Sequence
  KERE-class Nanobody FW4 sequence
WGLGTQVTISS

SEQ ID NO: 64 - protein, 30 aa, Artificial Sequence
  GLEW-class Nanobody FW1 sequence
QVQLVESGGGLVQPGGSLRLSCAASGFTFS

SEQ ID NO: 65 - protein, 30 aa, Artificial Sequence
  GLEW-class Nanobody FW1 sequence
EVHLVESGGGLVRPGGSLRLSCAAFGFIFK

SEQ ID NO: 66 - protein, 30 aa, Artificial Sequence
  GLEW-class Nanobody FW1 sequence
QVKLEESGGGLAQPGGSLRLSCVASGFTFS

SEQ ID NO: 67 - protein, 30 aa, Artificial Sequence
  GLEW-class Nanobody FW1 sequence
EVQLVESGGGLVQPGGSLRLSCVCVSSGCT

SEQ ID NO: 68 - protein, 30 aa, Artificial Sequence
  GLEW-class Nanobody FW1 sequence
EVQLVESGGGLALPGGSLTLSCVFSGSTFS

SEQ ID NO: 69 - protein, 22 aa, Artificial Sequence
  GLEW-class Nanobody FW1 sequence
VESGGGLVQPGGSLRLSCAASG

SEQ ID NO: 70 - protein, 22 aa, Artificial Sequence
  GLEW-class Nanobody FW1 sequence
EESGGGLAQPGGSLRLSCVASG

SEQ ID NO: 71 - protein, 22 aa, Artificial Sequence
  GLEW-class Nanobody FW1 sequence
VESGGGLALPGGSLTLSCVFSG

SEQ ID NO: 72 - protein, 14 aa, Artificial Sequence
  GLEW-class Nanobody FW2 sequence
WVRQAPGKVLEWVS

SEQ ID NO: 73 - protein, 14 aa, Artificial Sequence
  GLEW-class Nanobody FW2 sequence
WVRRPPGKGLEWVS

SEQ ID NO: 74 - protein, 14 aa, Artificial Sequence
  GLEW-class Nanobody FW2 sequence
WVRQAPGMGLEWVS

SEQ ID NO: 75 - protein, 14 aa, Artificial Sequence
  GLEW-class Nanobody FW2 sequence
WVRQAPGKEPEWVS

SEQ ID NO: 76 - protein, 14 aa, Artificial Sequence
  GLEW-class Nanobody FW2 sequence
WVRQAPGKDQEWVS

SEQ ID NO: 77 - protein, 14 aa, Artificial Sequence
  GLEW-class Nanobody FW2 sequence
WVRQAPGKAEEWVS

SEQ ID NO: 78 - protein, 14 aa, Artificial Sequence
  GLEW-class Nanobody FW2 sequence
WVRQAPGKGLEWVA

SEQ ID NO: 79 - protein, 14 aa, Artificial Sequence
  GLEW-class Nanobody FW2 sequence
WVRQAPGRATEWVS

SEQ ID NO: 80 - protein, 32 aa, Artificial Sequence
  GLEW-class Nanobody FW3 sequence
RFTISRDNAKNTLYLQMNSLKPEDTAVYYCVK

SEQ ID NO: 81 - protein, 32 aa, Artificial Sequence
  GLEW-class Nanobody FW3 sequence
RFTISRDNARNTLYLQMDSLIPEDTALYYCAR

SEQ ID NO: 82 - protein, 32 aa, Artificial Sequence
  GLEW-class Nanobody FW3 sequence
RFTSSRDNAKSTLYLQMNDLKPEDTALYYCAR

SEQ ID NO: 83 - protein, 32 aa, Artificial Sequence
  GLEW-class Nanobody FW3 sequence
RFIISRDNAKNTLYLQMNSLGPEDTAMYYCQR

SEQ ID NO: 84 - protein, 32 aa, Artificial Sequence
  GLEW-class Nanobody FW3 sequence
RFTASRDNAKNTLYLQMNSLKSEDTARYYCAR

SEQ ID NO: 85 - protein, 32 aa, Artificial Sequence
  GLEW-class Nanobody FW3 sequence
RFTISRDNAKNTLYLQMDDLQSEDTAMYYCGR

SEQ ID NO: 86 - protein, 11 aa, Artificial Sequence
  GLEW-class Nanobody FW4 sequence
GSQGTQVTVSS

SEQ ID NO: 87 - protein, 11 aa, Artificial Sequence
  GLEW-class Nanobody FW4 sequence
LRGGTQVTVSS

SEQ ID NO: 88 - protein, 11 aa, Artificial Sequence
  GLEW-class Nanobody FW4 sequence
RGQGTLVTVSS

SEQ ID NO: 89 - protein, 11 aa, Artificial Sequence
  GLEW-class Nanobody FW4 sequence
RSRGIQVTVSS

SEQ ID NO: 90 - protein, 11 aa, Artificial Sequence
  GLEW-class Nanobody FW4 sequence
WGKGTQVTVSS

SEQ ID NO: 91 - protein, 11 aa, Artificial Sequence
  GLEW-class Nanobody FW4 sequence
WGQGTQVTVSS

SEQ ID NO: 92 - protein, 30 aa, Artificial Sequence
  P,R,S 103-class Nanobody FW1 sequence
AVQLVESGGGLVQAGGSLRLSCAASGRTFS

SEQ ID NO: 93 - protein, 30 aa, Artificial Sequence
  P,R,S 103-class Nanobody FW1 sequence
QVQLQESGGGMVQPGGSLRLSCAASGFDFG

SEQ ID NO: 94 - protein, 30 aa, Artificial Sequence; identical to SEQ ID NO: 65
  P,R,S 103-class Nanobody FW1 sequence

SEQ ID NO: 95 - protein, 30 aa, Artificial Sequence
  P,R,S 103-class Nanobody FW1 sequence
QVQLAESGGGLVQPGGSLKLSCAASRTIVS

SEQ ID NO: 96 - protein, 30 aa, Artificial Sequence
  P,R,S 103-class Nanobody FW1 sequence
QEHLVESGGGLVDIGGSLRLSCAASERIFS

SEQ ID NO: 97 - protein, 30 aa, Artificial Sequence; identical to SEQ ID NO: 66
  P,R,S 103-class Nanobody FW1 sequence

SEQ ID NO: 98 - protein, 30 aa, Artificial Sequence; identical to SEQ ID NO: 67
  P,R,S 103-class Nanobody FW1 sequence

SEQ ID NO: 99 - protein, 30 aa, Artificial Sequence; identical to SEQ ID NO: 68
  P,R,S 103-class Nanobody FW1 sequence

SEQ ID NO: 100 - protein, 22 aa, Artificial Sequence
  P,R,S 103-class Nanobody FW1 sequence
VESGGGLVQAGGSLRLSCAASG

SEQ ID NO: 101 - protein, 22 aa, Artificial Sequence
  P,R,S 103-class Nanobody FW1 sequence
AESGGGLVQPGGSLKLSCAASR

SEQ ID NO: 102 - protein, 14 aa, Artificial Sequence
  P,R,S 103-class Nanobody FW2 sequence
WFRQAPGKEREFVA

SEQ ID NO: 103 - protein, 14 aa, Artificial Sequence
  P,R,S 103-class Nanobody FW2 sequence
WVRQAPGKVLEWVS

SEQ ID NO: 104 - protein, 14 aa, Artificial Sequence
  P,R,S 103-class Nanobody FW2 sequence
WVRRPPGKGLEWVS

SEQ ID NO: 105 - protein, 14 aa, Artificial Sequence
  P,R,S 103-class Nanobody FW2 sequence
WIRQAPGKEREGVS

SEQ ID NO: 106 - protein, 14 aa, Artificial Sequence
  P,R,S 103-class Nanobody FW2 sequence
WVRQYPGKEPEWVS

SEQ ID NO: 107 - protein, 14 aa, Artificial Sequence
  P,R,S 103-class Nanobody FW2 sequence
WFRQPPGKEHEFVA

SEQ ID NO: 108 - protein, 14 aa, Artificial Sequence
  P,R,S 103-class Nanobody FW2 sequence
WYRQAPGKRTELVA

SEQ ID NO: 109 - protein, 14 aa, Artificial Sequence
  P,R,S 103-class Nanobody FW2 sequence
WLRQAPGQGLEWVS

SEQ ID NO: 110 - protein, 14 aa, Artificial Sequence
  P,R,S 103-class Nanobody FW2 sequence
WLRQTPGKGLEWVG

SEQ ID NO: 111 - protein, 14 aa, Artificial Sequence
  P,R,S 103-class Nanobody FW2 sequence
WVRQAPGKAEEFVS

SEQ ID NO: 112 - protein, 32 aa, Artificial Sequence
  P,R,S 103-class Nanobody FW3 sequence
RFTISRDNAKNTVYLQMNSLKPEDTAVYYCAA

SEQ ID NO: 113 - protein, 32 aa, Artificial Sequence; identical to SEQ ID NO: 81
  P,R,S 103-class Nanobody FW3 sequence

SEQ ID NO: 114 - protein, 32 aa, Artificial Sequence
  P,R,S 103-class Nanobody FW3 sequence
RFTISRDNAKNEMYLQMNNLKTEDTGVYWCGA

SEQ ID NO: 115 - protein, 32 aa, Artificial Sequence
  P,R,S 103-class Nanobody FW3 sequence
RFTISSDSNRNMIYLQMNNLKPEDTAVYYCAA

SEQ ID NO: 116 - protein, 32 aa, Artificial Sequence
  P,R,S 103-class Nanobody FW3 sequence
RFTISRDNAKNMLYLHLNNLKSEDTAVYYCRR

SEQ ID NO: 117 - protein, 32 aa, Artificial Sequence
  P,R,S 103-class Nanobody FW3 sequence
RFTISRDNAKKTVYLRLNSLNPEDTAVYSCNL

SEQ ID NO: 118 - protein, 32 aa, Artificial Sequence
  P,R,S 103-class Nanobody FW3 sequence
RFKISRDNAKKTLYLQMNSLGPEDTAMYYCQR

SEQ ID NO: 119 - protein, 32 aa, Artificial Sequence
  P,R,S 103-class Nanobody FW3 sequence
RFTVSRDNGKNTAYLRMNSLKPEDTADYYCAV

SEQ ID NO: 120 - protein, 11 aa, Artificial Sequence
  P,R,S 103-class Nanobody FW4 sequence
RGQGTQVTVSS

SEQ ID NO: 121 - protein, 11 aa, Artificial Sequence
  P,R,S 103-class Nanobody FW4 sequence
LRGGTQVTVSS

SEQ ID NO: 122 - protein, 11 aa, Artificial Sequence
  P,R,S 103-class Nanobody FW4 sequence
GNKGTLVTVSS

SEQ ID NO: 123 - protein, 11 aa, Artificial Sequence
  P,R,S 103-class Nanobody FW4 sequence
SSPGTQVTVSS

SEQ ID NO: 124 - protein, 11 aa, Artificial Sequence
  P,R,S 103-class Nanobody FW4 sequence
SSQGTLVTVSS

SEQ ID NO: 125 - protein, 11 aa, Artificial Sequence
  P,R,S 103-class Nanobody FW4 sequence
RSRGIQVTVSS

SEQ ID NO: 126 - protein, 449 aa, Artificial Sequence
  Recombinant antibody
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 127 - protein, 214 aa, Artificial Sequence [sequence omitted]

SEQ ID NO: 128 - protein, 222 aa, Artificial Sequence
  Recombinant antibody
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 129 - protein, 214 aa, Artificial Sequence [sequence omitted]

SEQ ID NO: 130 - protein, 121 aa, Artificial Sequence [sequence omitted]

SEQ ID NO: 131 - protein, 322 aa, Artificial Sequence
  Hybrid IL-6R
MLAVGCALLAALLAAPGAALAPRRCPAQEVARGVLTSIPGATVTLICPGKEAAGNATIHWVYSGSQSREWTTTGNTLVLRAVQVNDTGHYLCFLDDHLVGTVPLLVDVPPEEPQLSCFRKSPLSNVVCEWGPRSTPSLTTKAVLLVRKFQNSPAEDFQEPCQYSQESQKFSCQLAVPEGDSSFYIVSMCVASSVGSKFSKTQTFQGCGILQPDPPANITVTAVARNPRWLSVTWQDPHSWNSSFYRLRFELRYRAERSKTFTTWMVKDLQHHCVIHDAWSGLRHVVQLRAQEEFGQGEWSEWSPEAMGTPWTGGGSHHHHHH

SEQ ID NO: 132 - protein, 119 aa, Artificial Sequence
  Nanobody
EVQLVESGGGLVQAGGSLRLSCAASGRGFSPYTMGWFRQAPGKERVFVAGISWSTGIAHYTDSVKGRFTISRDNAKNTGSLQMNSLKPEDTAVYYCAVVQTTKGNYDYWGQGTQVTVSS

SEQ ID NO: 133 - protein, 123 aa, Artificial Sequence
  Nanobody
EVQLVESGGGLVQAGDSLRLSCLASGRSFKDDAMGWFRQAPGKEREFVSGIDWRGNIVDAESVKGRFTISRENAKNTLYLQMNHLKPEDTAVYYCAASSVFSDLRYRKNPKYWGQGTQVTVSS

SEQ ID NO: 134 - protein, 123 aa, Artificial Sequence; identical to SEQ ID NO: 133
  Nanobody

SEQ ID NO: 135 - protein, 119 aa, Artificial Sequence; identical to SEQ ID NO: 132
  Nanobody

SEQ ID NO: 136 - protein, 123 aa, Artificial Sequence
  Nanobody
EVQLVESGGGTVQAGGSLKLSCAASGRTFTNYAMGWFRQAPGKEREFVAAIAYATHFADSVKGRFTISRGNAKNTVYLQMNSLKPEDTAVYYCAADLSLSKMVSKITSDMDYWGKGTLVTVSS

SEQ ID NO: 137 - protein, 122 aa, Artificial Sequence
  Nanobody
EVQLVESGGGLVQAGGPLRLSCTASGRTFTDYDMGWFRQAPGKEREVVAIIDTNGDNTLTVGSVKGRFAISSDNAKNTVYLQMNSLLPEDTAVYTCAAGAWSALRRSVANYWGQGTQVTVSS

SEQ ID NO: 138 - protein, 123 aa, Artificial Sequence
  Nanobody
EVQLVESGGGTVQAGGSLKLSCAASGRTFTNYAMGWFRQAPGKEREFVAAIAYATHFADSVKGRFTISRGNAKNTVYLQMNSLKPEDAAVYYCAADLSLSKMVSKITSDMDYWGKGTLVTVSS

SEQ ID NO: 139 - protein, 122 aa, Artificial Sequence
  Nanobody
EVQLVESGGGLVQAGGSLRLSCTASGRTFSDYDMGWFRQAPGKERECVAIIDTNGDNTLIVGSVKGRFAISSDNAKNTVYLQMNSLLPEDTAVYTCAAGVWSSLRHTAANYWGQGTQVTVSS

SEQ ID NO: 140 - protein, 128 aa, Artificial Sequence
  Nanobody
EVQLVESGGGLVQPGGSLRLSCAASGVTLDYYAIGWFRQAPGKEREGVSSISSNDGSTFYADSVKGRFTISRDKAKNTVYLQMNSLKPEDTAVYYCAATYLTAQAVGVPVAYYEFDYWGQGTQVTVSS

SEQ ID NO: 141 - protein, 122 aa, Artificial Sequence
  Nanobody
EVQLVESGGGLVQAGGSLRLSCTASGRTFTDYDMGWFRQAPGKEREVVAIIDTNGDNTLTVGSVKGRFAISSDNAKNTVYLQMNSLLPEDTAVYTCAAGAWSALRRSVANYWGQGTQVTVSS

SEQ ID NO: 142 - protein, 125 aa, Artificial Sequence
  Nanobody
EVQLVESGGGLVQAGGSLRLSCAASGSIFRINAMGWYRQAPGKQRELVAAAISGGSTNYADFVKGRFTISRDNAKNTVYLQMNSLKPEDTAVYYCNALVVSHNYSDYVPFPDDYWGQGTQVTVSS

SEQ ID NO: 143 - protein, 121 aa, Artificial Sequence
  Nanobody
EVQLVESGGGLVQAGGSLRLSCAASGSDFSIKAMGWYRQAPGKQRELVARITSGGSTVYADSVKGRFTISRDNAKNTVYLQMNSLKPEDATVYYCNAIVTYSDYDLGNDYWGQGTQVTVSS

SEQ ID NO: 144 - protein, 122 aa, Artificial Sequence; identical to SEQ ID NO: 139
  Nanobody

SEQ ID NO: 145 - protein, 126 aa, Artificial Sequence
  Nanobody
EVQLVESGGGLVRAGGSLRLSCAASGFAFDDYAIGWFRQAPGKEREGVSSISSSNGNTYYADSVRGRFTISSDNAKNTVYLQMNSLKPEDTGVYYCAAIWGIFFNEKMPVGAYDYWGQGTQVTVSS

SEQ ID NO: 146 - protein, 122 aa, Artificial Sequence; identical to SEQ ID NO: 139
  Nanobody

SEQ ID NO: 147 - protein, 126 aa, Artificial Sequence
  Nanobody
EVQMVESGGGLVQAGGSLRLSCAASGFAFDDYAIGWFRQAPGKEREGVSSISSSNGNTYYADSVRGRFTISSDNAKNTVYLQMNSLKPEDAGVYYCAAIWGIFFNEKMPVGAYDYWGQGTQVTVSS

SEQ ID NO: 148 - protein, 122 aa, Artificial Sequence; identical to SEQ ID NO: 139
  Nanobody

SEQ ID NO: 149 - protein, 126 aa, Artificial Sequence
  Nanobody
EVQLVESGGGLVQAGGSLRLSCAASGFAFDDYAIGWFRQAPGKEREGVSSISSSNGNTYYADSVRGRFTISSDNAKNTVYLQMNSLKPEDTGVYYCAAIWGIFFNEKMPVGAYDYWGQGTQVTVSS

SEQ ID NO: 150 - protein, 126 aa, Artificial Sequence; identical to SEQ ID NO: 149
  Nanobody

SEQ ID NO: 151 - protein, 126 aa, Artificial Sequence; identical to SEQ ID NO: 149
  Nanobody

SEQ ID NO: 152 - protein, 126 aa, Artificial Sequence; identical to SEQ ID NO: 149
  Nanobody

SEQ ID NO: 153 - protein, 121 aa, Artificial Sequence
  Nanobody
EVQLVESGGGLVQAGGSLRLSCAASGSIFSIKAMGWYRQAPGKQRELVARITSGGSTYYADSVKGRFTISRDNAKNTVYLQMNSLKPEDTAVFYCNAIVTDSDYDLGNDYWGQGTQVTVSS

SEQ ID NO: 154 - protein, 128 aa, Artificial Sequence
  Nanobody
EVQLVESGGGLVQPGGSLRLSCAASGGTLDYYAIGWFRQAPGKEREGVSCISSSDGSTYYASSVKGRFTVSRDKAKNTVYLQMNSLKPEDTAVYYCAFVFTTAQAMGVPNNPYEYDFWGQGTQVTVSS

SEQ ID NO: 155 - protein, 130 aa, Artificial Sequence
  Nanobody
EVQLVESGGGLVQPGGSLRLSCAASASGFTLDYYAIGWFRQAPGKEREGVSCISSTDGSTYYADSVKGRFTISRDNAKNTVYLQMNSLNPEDTGVYTCAAVLTTAQAMGVPTRSYEYDYWGQGTQVTVSS

SEQ ID NO: 156 - protein, 125 aa, Artificial Sequence; identical to SEQ ID NO: 142
  Nanobody

SEQ ID NO: 157 - protein, 122 aa, Artificial Sequence; identical to SEQ ID NO: 139
  Nanobody

SEQ ID NO: 158 - protein, 126 aa, Artificial Sequence; identical to SEQ ID NO: 149
  Nanobody

SEQ ID NO: 159 - protein, 126 aa, Artificial Sequence; identical to SEQ ID NO: 149
  Nanobody

SEQ ID NO: 160 - protein, 122 aa, Artificial Sequence
  Nanobody
EMQLVESGGGLVQAGGSLRLSCTASGRTFTDYDMGWFRQAPGKEREVVAIIDTNGDNTLTVGSVKGRFAISSDNAKNTVYLQMNSLLPEDTAVYTCAAGAWSALRRSVANYWGQGTQVTVSS

SEQ ID NO: 161 - protein, 116 aa, Artificial Sequence
  Nanobody
EVQLVESGGGLVQAGGSLRLSCAASGSIDRINAMGWYRQAPGKQRDFLAVITDGDKTLYADSVKGRFTISNDNAKNTVYLQMNSLKPEDTAVYYCNAYQAGWGDYWGQGTQVTVSS

SEQ ID NO: 162 - protein, 120 aa, Artificial Sequence
  Nanobody
EVQLVESGGGLVQPGGSLRLSCAASGSIFSINTMGWYRQVPGKQRELVATVRSGSITNYADSVQDQFTITRDIDENTVYLQMNSLKPEDTAVYYCLTRASVPGRGYQDYWGQGTQVTVSS

SEQ ID NO: 163 - protein, 120 aa, Artificial Sequence
  Nanobody
EVQLVESGGGLVQPGGSLRLSCAASGSIFSINTMGWYRQVPGKQRELVATVRSGSITNYADSVQDRFTITRDIDENTVYLQMNSLKPEDTAVYYCLTRASVPGRGYQDYWGQGTQVTVSS

SEQ ID NO: 164 - protein, 123 aa, Artificial Sequence
  Nanobody
EVQLVESGGGLVQAGDSLRLSCVASGLPFSTLHMGWFRQAPGKEHESVSAISSDGGSEYYAGSVKGRFTISRDNAKNTVYLQMNSLKPEDTAVYYCAADPRRIGANIKYSDYWGQGTQVTVSS

SEQ ID NO: 165 - protein, 124 aa, Artificial Sequence
  Nanobody
EVQLVESGGGLVQPGGSLRLSCAASGSTFSINMMAWYCQAPGKQRELVASISSGGGINYADSVKGRFTISRDYAENSVDLQMNSLKPEDTAVYYCNARGTYLNGDHYSTNYNSWGQGTQVTVSS

SEQ ID NO: 166 - protein, 121 aa, Artificial Sequence
  Nanobody
EVQLVESGGGLVQPGGSMRLSCAATGAIFSISTMGWYRQAPGAQREFVAGVGLDGTPNYADSVKGRFTISRDNTKNTVSLQMENLKPEDTGVYYCNIDEGMDYDGNFYDRWGQGTQVTVSS

SEQ ID NO: 167 - protein, 126 aa, Artificial Sequence
  Nanobody
EVQLVESGGGLVEAGGSLRLSCAAAGRTLSSYSMAWFRQAPGKEREFVAIIRGNPSRTYHSDSVKGRFTASRDNAKNTVYLQMNRLEPEDTAVYYCAADPPPFASDYSAPQSYDYWGQGTQVTVSS

SEQ ID NO: 168 - protein, 128 aa, Artificial Sequence
  Nanobody
EVQLVESGGGLVQAGGSLSLSCATSGRTISDDTMAWFRQAPGKEREFVATITFSGARTHYSDSVRDRFTISRDNAKNTVYLQMDSLKSEDTAVYYCAASTKYYSSTYNYIHPAFYDIWGQGTQVTVSS

SEQ ID NO: 169 - protein, 126 aa, Artificial Sequence; identical to SEQ ID NO: 167
  Nanobody

SEQ ID NO: 170 - protein, 125 aa, Artificial Sequence
  Nanobody
EVQLVESGGGLVQAGGSLRLSCVASGHTSDTYIMAWFRQAPGKEREFVASILWDGSITYYADSVKDRFTISRDISRKTLYLQMNSLRPEDTATYTCARGIYFSRRYVDPGIYGTWGQGTQVTVSS

SEQ ID NO: 171 - protein, 119 aa, Artificial Sequence
  Nanobody
EVQLVESGGGLVQPGGSLRLSCAASKSIFDINAMYWHRQAPGKQRESVASITSGGMRNYADSVKDRFTISKDNAKNTVYLQMNGLKPDDTAVYYCGLGRYEGGVWRDYWGQGTQVTVSS

SEQ ID NO: 172 - protein, 122 aa, Artificial Sequence
  Nanobody
EVQLVESGGGLVQAGGSLRLSCTASGRTFSDYDMGWFRQAPGKEREFVAVIDTNGGHTLTVGSVKGRFAISSDNAKNTVYLQMNSLVPEDTAVYTCAAGAWSSLRKTAASYWGQGTQVTVSS

SEQ ID NO: 173 - protein, 126 aa, Artificial Sequence; identical to SEQ ID NO: 149
  Nanobody

SEQ ID NO: 174 - protein, 122 aa, Artificial Sequence; identical to SEQ ID NO: 139
  Nanobody

SEQ ID NO: 175 - protein, 123 aa, Artificial Sequence; identical to SEQ ID NO: 136
  Nanobody

SEQ ID NO: 176 - protein, 118 aa, Artificial Sequence
  Nanobody
EVQLVESGGGLVQAGGSLRLSCAAGGSIFSINAMGWYRQAPGKQRELVASITSGGSTTYADSVKGRFTISRDNAKDTVYLQMNSLKPEDTAVYYCNAHIRFPFPNDYWGQGTQVTVSS

SEQ ID NO: 177 - protein, 126 aa, Artificial Sequence; identical to SEQ ID NO: 145
  Nanobody

SEQ ID NO: 178 - protein, 125 aa, Artificial Sequence
  Nanobody
EVQLVESGGGLVQAGGSLRLSCAASGSIFRINAMGWYRQAPGEQRELVAAAISGGSTNYADFVKGRFTISRDNAKNTVYLQMNSLKPEDTAVYYCNALVVSHNYSDYVPFPDDYWGQGTQVTVSS

SEQ ID NO: 179 - protein, 125 aa, Artificial Sequence
  Nanobody
EVQLEESGGGLVQAGGSLRLSCAASGSIFRINAMGWYRQAPGKQRELVAAAISGGSTNYADFVKGRFTISRDNAKNTVYLQMNSLKPEDTAVYYCNALVVSHNYSDYVPFPDDYWGQGTQVTVSS

SEQ ID NO: 180 - protein, 121 aa, Artificial Sequence; identical to SEQ ID NO: 153
  Nanobody

SEQ ID NO: 181 - protein, 126 aa, Artificial Sequence
  Nanobody
EVQLVESGGGLVQAGGSLRLSCAASGFAFDDYAIGWFRQAPGKEREGVSSISSSNGNTYYADSVRGRFTISSDNAKNTVYLQMNGLKPEDTGVYYCAAIWGIFFNEKMPVGAYDYWGQGTQVTVSS

SEQ ID NO: 182 - protein, 126 aa, Artificial Sequence; identical to SEQ ID NO: 147
  Nanobody

SEQ ID NO: 183 - protein, 125 aa, Artificial Sequence; identical to SEQ ID NO: 142
  Nanobody

SEQ ID NO: 184 - protein, 128 aa, Artificial Sequence
  Nanobody
EVQLVESGGGLVQAGGSLRLSCAASGFTFDDYAIGWFRQAPGKEREGVSCMISSDGSTYYADSVKGRFTISSDNAKNTVYLQMDSLKPEDTAVYYCAADLSLYGCYVGDRDLYDYDYWGQGTQVTVSS

SEQ ID NO: 185 - protein, 125 aa, Artificial Sequence
  Nanobody
EVQLVESGGGLVQAGGSLRLSCAASGSIFRINAMGWYRQAPGKQRELVAAAISGGSTNYADFVKGRFTISRDNAKNTVYLQMNSLKPGDTAVYYCNALVVSHNYSDYVPFPDDYWGQGTQVTVSS

SEQ ID NO: 186 - protein, 125 aa, Artificial Sequence
  Nanobody
EVQLVESEGGLVQAGGSLRLSCAASGSIFRINAMGWYRQAPGKQRELVAAAISGGSTNYADFVKGRFTISRDNAKNTVYLQMNSLKPEDTAVYYCNALVVSHNYSDYVPFPDDYWGQGTQVTVSS

SEQ ID NO: 187 - protein, 116 aa, Artificial Sequence
  Nanobody
EVQLVESGGGLVQAGGSLNLSCNASGDIGSINAMGWYRQAPGQQREWVAVITDTDSTIYPDSVKGRFAISRDGAKNTVHLRMSSLKPEDTAVYYCNAYQAGWGDYWGQGTQVTVSS

SEQ ID NO: 188 - protein, 118 aa, Artificial Sequence
  Nanobody
EVQLVESGGGLVQAGGSLRLSCAASGGIFSDMFMGWFRQAPGKSRESVARISPSGNTFYQDSVRGRFTISTDNAKNTVYLQMNNLKPEDTAVYYCAANVGVTGSYEYWGQGTQVTVSS

SEQ ID NO: 189 - protein, 123 aa, Artificial Sequence
  Nanobody
EVQLVESGGGLVQAGGSLRLSCVASGLRLNMHRMGWFRQAPGKEREFVARIFTDDGDSYYADSVQGRFTISGDNAKNTVYLQMNSLKPEDTGVYFCAAGYMSGAESPIGYDNWGQGTQVTVSS

SEQ ID NO: 190 - protein, 116 aa, Artificial Sequence
  Nanobody
EVQLVESGGGLVQAGGSLNLSCNASGDIGSINAMGWHRQAPGQQREWVAVITDTDSTIYPDSVKGRFAISRDGAKNTVHLRMSSLKPEDTAVYYCNAYQAGWGDYWGQGTQVTVSS

SEQ ID NO: 191 - protein, 116 aa, Artificial Sequence; identical to SEQ ID NO: 161
  Nanobody

SEQ ID NO: 192 - protein, 116 aa, Artificial Sequence
  Nanobody
EVQLVESGGGLVQAGGSLRLSCAASGSIENINAMGWYRQAPGKQRDFLAIITDGSKTLYADSVKGRFTISNDNAKNTVYLQMNSLKPEDTAVYYCNAYQAGWGDYWGQGTQVTVSS

SEQ ID NO: 193 - protein, 121 aa, Artificial Sequence
  Nanobody
KVQLVESGGGLVQPGGSLRLSCAASGFTFSSYAMSWVRRAPGKGLEWVSAINSDGTGSSYAPFVTGRFTASRDNAKNTLYLQMNSLKPEDTAVYYCTNSNRYDYADFSAVRGQGTQVTVSS

SEQ ID NO: 194 - protein, 116 aa, Artificial Sequence
  Nanobody
EVPLVESGGGLVQAGGSLNLSCNASGDIGSINAMGWYRQAPGQQREWVAVITDTDSTIYPDSVKGRFAISRDGAKNTVHLRMSSLKPEDTAVYYCNAYQAGWGDYWGQGTQVTVSS

SEQ ID NO: 195 - protein, 122 aa, Artificial Sequence
  Nanobody
EVQLVESGGGLVQPGGSLRLSCTASGRTFSDYDMGWFRQAPGKERECVAVIDTNGDNTLTVGSVKGRFAISRDNAKNTVYLQMNSLLPEDTAVYTCAAGAWSSLRSTAANYWGQGTQVTVSS

SEQ ID NO: 196 - protein, 121 aa, Artificial Sequence
  Nanobody
EVQLVESGGGLVQAGGSLRLSCAASGRTYAMAWFRQAPGKEREFVAAISIVTDYADSVKGRFNISRDNRENTVYLQMNSLKPEDTAVYYCAANTYYSGAYFPRGHEWYEYWGQGTQVTVSS

SEQ ID NO: 197 - protein, 122 aa, Artificial Sequence
  Nanobody
EVQLVESGGGLVQAGGSLRLSCTASGRTFSDYDMGWFRQAPGKERECVAVIDTNGDNTLTVGSVKGRFAISRDNAKNTVYLQMNSLLPEDTAVYTCAAGAWSSLRSTAANYWGQGTKVTVSS

SEQ ID NO: 198 - protein, 122 aa, Artificial Sequence
  Nanobody
EVQLVESGGGSVQAGGSLRLSCTASGRTFSDYDMGWFRQAPGKERECVAVIDTNGDNTLTVGSVKGRFAISRDNAKNTVYLQMNSLLPEDTAVYTCAAGAWSSLRSTAANYWGQGTQVTVSS

SEQ ID NO: 199 - protein, 127 aa, Artificial Sequence
  Nanobody
EVQLVESGGGLVQAGGSLRLSCAASGFTFDDYDIGWFRQAPGKEREGVSGISSSDGNTYYADSVKGRFTISSDNAKNTVYLQMNSLKPEDTAVYYCAAEPPDSSWYLDGSPEFFKYWGQGTQVTVSS

SEQ ID NO: 200 - protein, 127 aa, Artificial Sequence; identical to SEQ ID NO: 199
  Nanobody

SEQ ID NO: 201 - protein, 125 aa, Artificial Sequence
  Nanobody
EVQLVESGGGLVQAGGSLRLSCAFSRRSFGNFPMGWFRQRPGEEREYVAVISWNNNYIHYRDSVKGRFTASRDTSENRMYLQMNGLKPEDTAVYYCAARTKDNTLFTPAEEYDYWGQGTQVTVSS

SEQ ID NO: 202 - protein, 122 aa, Artificial Sequence
  Nanobody
EVQLVESGGGLVQAGGSLRLSCTASGRTFSDYDMGWFRQAPGKERECVAVIDTNGDNTLTVGSVKGRFAISRDNAKNTVYLQMNSLLPEDTAVYTCAAGAWSSLRSTAANYWGQGTQVTVSS

SEQ ID NO: 203 - protein, 119 aa, Artificial Sequence; identical to SEQ ID NO: 171
  Nanobody

SEQ ID NO: 204 - protein, 128 aa, Artificial Sequence
  Nanobody
EVQLVESGGGLVQAGGSLSLSCATSGRTISDDTMAWFRQAPGKEREFVATITFSGARTHYSDSVRDRFTISRDNAKNTVYLQMNSLKSEDTAVYYCAASTKYYSSTYNYIHPAFYDIWGQGTQVTVSS

SEQ ID NO: 205 - protein, 128 aa, Artificial Sequence
  Nanobody
EVQLVESGGGLVQAGGSLSLSCATSGRTISDDTMAWFRQAPGKEREFVAIITFNGARTHYSDSVRDRFTISRDNAKNTVYLQMNSLKSEDTAVYYCAASTKYYSSTYNYIHPAFYDIWGQGTQVTVSS

SEQ ID NO: 206 - protein, 128 aa, Artificial Sequence; identical to SEQ ID NO: 204
  Nanobody

SEQ ID NO: 207 - protein, 128 aa, Artificial Sequence; identical to SEQ ID NO: 204
  Nanobody

SEQ ID NO: 208 - protein, 128 aa, Artificial Sequence; identical to SEQ ID NO: 204
  Nanobody

SEQ ID NO: 209 - protein, 128 aa, Artificial Sequence; identical to SEQ ID NO: 205
  Nanobody

SEQ ID NO: 210 - protein, 128 aa, Artificial Sequence; identical to SEQ ID NO: 204
  Nanobody

SEQ ID NO: 211 - protein, 123 aa, Artificial Sequence
  Nanobody
EVQLVESGGRSVQAGGSLRLSCAASGRTFRDYAMGWFRQAPGKEREFVAVISWSGAYTEYADSVKGRFTISRNNAANTGALQMNSLKLEDTAVYYCAATMVPRAMVVDEFEYWGQGTQVTVSS

SEQ ID NO: 212 - protein, 128 aa, Artificial Sequence; identical to SEQ ID NO: 204
  Nanobody

SEQ ID NO: 213 - protein, 117 aa, Artificial Sequence
  Nanobody
EVQLVESGGGLVQTGGSLRLSCAVSGRTDSTASVGWFRQAPGKQREWVVGISSGGSTHYADSVKGRFISSQDDAKNTVYLQMNSLKPEDTAIYYCAIAHGSSTYNYWGQGTQVTVSS

SEQ ID NO: 214 - protein, 119 aa, Artificial Sequence
  Nanobody
EVQLVESGGGLVQAGGSVRLSCTASGGTLSGNAMGWFRQAPGTEREFVAAITWSGDMSVYAEFVKGRFTVSRDNAKSVVYLQMNRLKPEDTSVYYCAGDIRGRENFGSWGQGTQVTVSS

SEQ ID NO: 215 - protein, 119 aa, Artificial Sequence
  Nanobody
EVQLVESGGDLVQTGGSLRLSCAASGITVSDRAMGWYRQAPGKQREMVAGVSRGGMTSYADSVKGRLTISRDNAKNSVYLQMNSLNPEDTAVYYCSAYYRYGSSVPQYWGQGTQVTVSS

SEQ ID NO: 216 - protein, 116 aa, Artificial Sequence
  Nanobody
EVQLVESGGGLVQPGGSLRLSCVVSGIIFSDNAMGWYRQYPGKQREWVAGISRGGTTGYTDSVKGRFTISRDNAKNTVYLQMNSLKPEDTAVYYCAIPTENQPDHWGQGTQVTVSS

SEQ ID NO: 217 - protein, 30 aa, Artificial Sequence
  Framework sequence
EVQLVESGGGLVQAGGSLRLSCAASGRGFS

SEQ ID NO: 218 - protein, 30 aa, Artificial Sequence
  Framework sequence
EVQLVESGGGLVQAGDSLRLSCLASGRSFK

SEQ ID NO: 219 - protein, 30 aa, Artificial Sequence; identical to SEQ ID NO: 218
  Framework sequence

SEQ ID NO: 220 - protein, 30 aa, Artificial Sequence; identical to SEQ ID NO: 217
  Framework sequence

SEQ ID NO: 221 - protein, 30 aa, Artificial Sequence
  Framework sequence
EVQLVESGGGTVQAGGSLKLSCAASGRTFT

SEQ ID NO: 222 - protein, 30 aa, Artificial Sequence
  Framework sequence
EVQLVESGGGLVQAGGPLRLSCTASGRTFT

SEQ ID NO: 223 - protein, 30 aa, Artificial Sequence; identical to SEQ ID NO: 221
  Framework sequence

SEQ ID NO: 224 - protein, 30 aa, Artificial Sequence
  Framework sequence
EVQLVESGGGLVQAGGSLRLSCTASGRTFS

SEQ ID NO: 225 - protein, 30 aa, Artificial Sequence
  Framework sequence
EVQLVESGGGLVQPGGSLRLSCAASGVTLD

SEQ ID NO: 226 - protein, 30 aa, Artificial Sequence
  Framework sequence
EVQLVESGGGLVQAGGSLRLSCTASGRTFT

SEQ ID NO: 227 - protein, 30 aa, Artificial Sequence
  Framework sequence
EVQLVESGGGLVQAGGSLRLSCAASGSIFR

SEQ ID NO: 228 - protein, 30 aa, Artificial Sequence
  Framework sequence
EVQLVESGGGLVQAGGSLRLSCAASGSDFS

SEQ ID NO: 229 - protein, 30 aa, Artificial Sequence; identical to SEQ ID NO: 224
  Framework sequence

SEQ ID NO: 230 - protein, 30 aa, Artificial Sequence
  Framework sequence
EVQLVESGGGLVRAGGSLRLSCAASGFAFD

SEQ ID NO: 231 - protein, 30 aa, Artificial Sequence; identical to SEQ ID NO: 224
  Framework sequence

SEQ ID NO: 232 - protein, 30 aa, Artificial Sequence
  Framework sequence
EVQMVESGGGLVQAGGSLRLSCAASGFAFD

SEQ ID NO: 233 - protein, 30 aa, Artificial Sequence; identical to SEQ ID NO: 224
  Framework sequence

SEQ ID NO: 234 - protein, 30 aa, Artificial Sequence
  Framework sequence
EVQLVESGGGLVQAGGSLRLSCAASGFAFD

SEQ ID NO: 235 - protein, 30 aa, Artificial Sequence; identical to SEQ ID NO: 234
  Framework sequence

SEQ ID NO: 236 - protein, 30 aa, Artificial Sequence; identical to SEQ ID NO: 234
  Framework sequence

SEQ ID NO: 237 - protein, 30 aa, Artificial Sequence; identical to SEQ ID NO: 234
  Framework sequence

SEQ ID NO: 238 - protein, 30 aa, Artificial Sequence
  Framework sequence
EVQLVESGGGLVQAGGSLRLSCAASGSIFS

SEQ ID NO: 239 - protein, 30 aa, Artificial Sequence
  Framework sequence
EVQLVESGGGLVQPGGSLRLSCAASGGTLD

SEQ ID NO: 240 - protein, 30 aa, Artificial Sequence
  Framework sequence
EVQLVESGGGLVQPGGSLRLSCAASASGFT

SEQ ID NO: 241 - protein, 30 aa, Artificial Sequence; identical to SEQ ID NO: 227
  Framework sequence

SEQ ID NO: 242 - protein, 30 aa, Artificial Sequence; identical to SEQ ID NO: 224
  Framework sequence

SEQ ID NO: 243 - protein, 30 aa, Artificial Sequence; identical to SEQ ID NO: 234
  Framework sequence

SEQ ID NO: 244 - protein, 30 aa, Artificial Sequence; identical to SEQ ID NO: 234
  Framework sequence

SEQ ID NO: 245 - protein, 30 aa, Artificial Sequence
  Framework sequence
EMQLVESGGGLVQAGGSLRLSCTASGRTFT

SEQ ID NO: 246 - protein, 30 aa, Artificial Sequence
  Framework sequence
EVQLVESGGGLVQAGGSLRLSCAASGSIDR

SEQ ID NO: 247 - protein, 30 aa, Artificial Sequence
  Framework sequence
EVQLVESGGGLVQPGGSLRLSCAASGSIFS

SEQ ID NO: 248 - protein, 30 aa, Artificial Sequence; identical to SEQ ID NO: 247
  Framework sequence

SEQ ID NO: 249 - protein, 30 aa, Artificial Sequence
  Framework sequence
EVQLVESGGGLVQAGDSLRLSCVASGLPFS

SEQ ID NO: 250 - protein, 30 aa, Artificial Sequence
  Framework sequence
EVQLVESGGGLVQPGGSLRLSCAASGSTFS

SEQ ID NO: 251 - protein, 30 aa, Artificial Sequence
  Framework sequence
EVQLVESGGGLVQPGGSMRLSCAATGAIFS

SEQ ID NO: 252 - protein, 30 aa, Artificial Sequence
  Framework sequence
EVQLVESGGGLVEAGGSLRLSCAAAGRTLS

SEQ ID NO: 253 - protein, 30 aa, Artificial Sequence
  Framework sequence
EVQLVESGGGLVQAGGSLSLSCATSGRTIS

SEQ ID NO: 254 - protein, 30 aa, Artificial Sequence; identical to SEQ ID NO: 252
  Framework sequence

SEQ ID NO: 255 - protein, 30 aa, Artificial Sequence
  Framework sequence
EVQLVESGGGLVQAGGSLRLSCVASGHTSD

SEQ ID NO: 256 - protein, 30 aa, Artificial Sequence
  Framework sequence
EVQLVESGGGLVQPGGSLRLSCAASKSIFD

SEQ ID NO: 257 - protein, 30 aa, Artificial Sequence; identical to SEQ ID NO: 224
  Framework sequence

SEQ ID NO: 258 - protein, 30 aa, Artificial Sequence; identical to SEQ ID NO: 234
  Framework sequence

SEQ ID NO: 259 - protein, 30 aa, Artificial Sequence; identical to SEQ ID NO: 224
  Framework sequence

SEQ ID NO: 260 - protein, 30 aa, Artificial Sequence; identical to SEQ ID NO: 221
  Framework sequence

SEQ ID NO: 261 - protein, 30 aa, Artificial Sequence
  Framework sequence
EVQLVESGGGLVQAGGSLRLSCAAGGSIFS

SEQ ID NO: 262 - protein, 30 aa, Artificial Sequence; identical to SEQ ID NO: 230
  Framework sequence

SEQ ID NO: 263 - protein, 30 aa, Artificial Sequence; identical to SEQ ID NO: 227
  Framework sequence

SEQ ID NO: 264 - protein, 30 aa, Artificial Sequence
  Framework sequence
EVQLEESGGGLVQAGGSLRLSCAASGSIFR

SEQ ID NO: 265 - protein, 30 aa, Artificial Sequence; identical to SEQ ID NO: 238
  Framework sequence

SEQ ID NO: 266 - protein, 30 aa, Artificial Sequence; identical to SEQ ID NO: 234
  Framework sequence

SEQ ID NO: 267 - protein, 30 aa, Artificial Sequence; identical to SEQ ID NO: 232
  Framework sequence

SEQ ID NO: 268 - protein, 30 aa, Artificial Sequence; identical to SEQ ID NO: 227
  Framework sequence

SEQ ID NO: 269 - protein, 30 aa, Artificial Sequence
  Framework sequence
EVQLVESGGGLVQAGGSLRLSCAASGFTFD

SEQ ID NO: 270 - protein, 30 aa, Artificial Sequence; identical to SEQ ID NO: 227
  Framework sequence

SEQ ID NO: 271 - protein, 30 aa, Artificial Sequence
  Framework sequence
EVQLVESEGGLVQAGGSLRLSCAASGSIFR

SEQ ID NO: 272 - protein, 30 aa, Artificial Sequence
  Framework sequence
EVQLVESGGGLVQAGGSLNLSCNASGDIGS

SEQ ID NO: 273 - protein, 30 aa, Artificial Sequence
  Framework sequence
EVQLVESGGGLVQAGGSLRLSCAASGGIFS

SEQ ID NO: 274 - protein, 30 aa, Artificial Sequence
  Framework sequence
EVQLVESGGGLVQAGGSLRLSCVASGLRLN

SEQ ID NO: 275 - protein, 30 aa, Artificial Sequence; identical to SEQ ID NO: 272
  Framework sequence

SEQ ID NO: 276 - protein, 30 aa, Artificial Sequence; identical to SEQ ID NO: 246
  Framework sequence

SEQ ID NO: 277 - protein, 30 aa, Artificial Sequence
  Framework sequence
EVQLVESGGGLVQAGGSLRLSCAASGSIEN

SEQ ID NO: 278 - protein, 30 aa, Artificial Sequence
  Framework sequence
KVQLVESGGGLVQPGGSLRLSCAASGFTFS

SEQ ID NO: 279 - protein, 30 aa, Artificial Sequence
  Framework sequence
EVPLVESGGGLVQAGGSLNLSCNASGDIGS

SEQ ID NO: 280 - protein, 30 aa, Artificial Sequence
  Framework sequence
EVQLVESGGGLVQPGGSLRLSCTASGRTFS

SEQ ID NO: 281 - protein, 30 aa, Artificial Sequence
  Framework sequence
EVQLVESGGGLVQAGGSLRLSCAASGRTYA

SEQ ID NO: 282 - protein, 30 aa, Artificial Sequence; identical to SEQ ID NO: 224
  Framework sequence

SEQ ID NO: 283 - protein, 30 aa, Artificial Sequence
  Framework sequence
EVQLVESGGGSVQAGGSLRLSCTASGRTFS

SEQ ID NO: 284 - protein, 30 aa, Artificial Sequence; identical to SEQ ID NO: 269
  Framework sequence

SEQ ID NO: 285 - protein, 30 aa, Artificial Sequence; identical to SEQ ID NO: 269
  Framework sequence

SEQ ID NO: 286 - protein, 30 aa, Artificial Sequence
  Framework sequence
EVQLVESGGGLVQAGGSLRLSCAFSRRSFG

SEQ ID NO: 287 - protein, 30 aa, Artificial Sequence; identical to SEQ ID NO: 224
  Framework sequence

SEQ ID NO: 288 - protein, 30 aa, Artificial Sequence; identical to SEQ ID NO: 256
  Framework sequence

SEQ ID NO: 289 - protein, 30 aa, Artificial Sequence; identical to SEQ ID NO: 253
  Framework sequence

SEQ ID NO: 290 - protein, 30 aa, Artificial Sequence; identical to SEQ ID NO: 253
  Framework sequence

SEQ ID NO: 291 - protein, 30 aa, Artificial Sequence; identical to SEQ ID NO: 253
  Framework sequence

SEQ ID NO: 292 - protein, 30 aa, Artificial Sequence; identical to SEQ ID NO: 253
  Framework sequence

SEQ ID NO: 293 - protein, 30 aa, Artificial Sequence; identical to SEQ ID NO: 253
  Framework sequence

SEQ ID NO: 294 - protein, 30 aa, Artificial Sequence; identical to SEQ ID NO: 253
  Framework sequence

SEQ ID NO: 295 - protein, 30 aa, Artificial Sequence; identical to SEQ ID NO: 253
  Framework sequence

SEQ ID NO: 296 - protein, 30 aa, Artificial Sequence
  Framework sequence
EVQLVESGGRSVQAGGSLRLSCAASGRTFR

SEQ ID NO: 297 - protein, 30 aa, Artificial Sequence; identical to SEQ ID NO: 253
  Framework sequence

SEQ ID NO: 298 - protein, 30 aa, Artificial Sequence
  Framework sequence
EVQLVESGGGLVQTGGSLRLSCAVSGRTDS

SEQ ID NO: 299 - protein, 30 aa, Artificial Sequence
  Framework sequence
EVQLVESGGGLVQAGGSVRLSCTASGGTLS

SEQ ID NO: 300 - protein, 30 aa, Artificial Sequence
  Framework sequence
EVQLVESGGDLVQTGGSLRLSCAASGITVS

SEQ ID NO: 301 - protein, 30 aa, Artificial Sequence
  Framework sequence
EVQLVESGGGLVQPGGSLRLSCVVSGIIFS

SEQ ID NO: 302 - protein, 5 aa, Artificial Sequence
  CDR sequence
PYTMG

SEQ ID NO: 303 - protein, 5 aa, Artificial Sequence
  CDR sequence
DDAMG

SEQ ID NO: 304 - protein, 5 aa, Artificial Sequence
  CDR sequence
DDAMG

SEQ ID NO: 305 - protein, 5 aa, Artificial Sequence
  CDR sequence
PYTMG

SEQ ID NO: 306 - protein, 5 aa, Artificial Sequence
  CDR sequence
NYAMG

SEQ ID NO: 307 - protein, 5 aa, Artificial Sequence
  CDR sequence
DYDMG

SEQ ID NO: 308 - protein, 5 aa, Artificial Sequence
  CDR sequence
NYAMG

SEQ ID NO: 309 - protein, 5 aa, Artificial Sequence
  CDR sequence
DYDMG

SEQ ID NO: 310 - protein, 5 aa, Artificial Sequence
  CDR sequence
YYAIG

SEQ ID NO: 311 - protein, 5 aa, Artificial Sequence
  CDR sequence
DYDMG

SEQ ID NO: 312 - protein, 5 aa, Artificial Sequence
  CDR sequence
INAMG

SEQ ID NO: 313 - protein, 5 aa, Artificial Sequence
  CDR sequence
IKAMG

SEQ ID NO: 314 - protein, 5 aa, Artificial Sequence
  CDR sequence
DYDMG

SEQ ID NO: 315 - protein, 5 aa, Artificial Sequence
  CDR sequence
DYAIG

SEQ ID NO: 316 - protein, 5 aa, Artificial Sequence
  CDR sequence
DYDMG

SEQ ID NO: 317 - protein, 5 aa, Artificial Sequence
  CDR sequence
DYAIG

SEQ ID NO: 318 - protein, 5 aa, Artificial Sequence
  CDR sequence
DYDMG

SEQ ID NO: 319 - protein, 5 aa, Artificial Sequence
  CDR sequence
DYAIG

SEQ ID NO: 320 - protein, 5 aa, Artificial Sequence
  CDR sequence
DYAIG

SEQ ID NO: 321 - protein, 5 aa, Artificial Sequence
  CDR sequence
DYAIG

SEQ ID NO: 322 - protein, 5 aa, Artificial Sequence
  CDR sequence
DYAIG

SEQ ID NO: 323 - protein, 5 aa, Artificial Sequence
  CDR sequence
IKAMG

SEQ ID NO: 324 - protein, 5 aa, Artificial Sequence
  CDR sequence
YYAIG

SEQ ID NO: 325 - protein, 7 aa, Artificial Sequence
  CDR sequence
LDYYAIG

SEQ ID NO: 326 - protein, 5 aa, Artificial Sequence
  CDR sequence
INAMG

SEQ ID NO: 327 - protein, 5 aa, Artificial Sequence
  CDR sequence
DYDMG

SEQ ID NO: 328 - protein, 5 aa, Artificial Sequence
  CDR sequence
DYAIG

SEQ ID NO: 329 - protein, 5 aa, Artificial Sequence
  CDR sequence
DYAIG

SEQ ID NO: 330 - protein, 5 aa, Artificial Sequence
  CDR sequence
DYDMG

SEQ ID NO: 331 - protein, 5 aa, Artificial Sequence
  CDR sequence
INAMG

SEQ ID NO: 332 - protein, 5 aa, Artificial Sequence
  CDR sequence
INTMG

SEQ ID NO: 333 - protein, 5 aa, Artificial Sequence
  CDR sequence
INTMG

SEQ ID NO: 334 - protein, 5 aa, Artificial Sequence
  CDR sequence
TLHMG

SEQ ID NO: 335 - protein, 5 aa, Artificial Sequence
  CDR sequence
INMMA

SEQ ID NO: 336 - protein, 5 aa, Artificial Sequence
  CDR sequence
ISTMG

SEQ ID NO: 337 - protein, 5 aa, Artificial Sequence
  CDR sequence
SYSMA

SEQ ID NO: 338 - protein, 5 aa, Artificial Sequence
  CDR sequence
DDTMA

SEQ ID NO: 339 - protein, 5 aa, Artificial Sequence
  CDR sequence
SYSMA

SEQ ID NO: 340 - protein, 5 aa, Artificial Sequence
  CDR sequence
TYIMA

SEQ ID NO: 341 - protein, 5 aa, Artificial Sequence
  CDR sequence
INAMY

SEQ ID NO: 342 - protein, 5 aa, Artificial Sequence
  CDR sequence
DYDMG

SEQ ID NO: 343 - protein, 5 aa, Artificial Sequence
  CDR sequence
DYAIG

SEQ ID NO: 344 - protein, 5 aa, Artificial Sequence
  CDR sequence
DYDMG

SEQ ID NO: 345 - protein, 5 aa, Artificial Sequence
  CDR sequence
NYAMG

SEQ ID NO: 346 - protein, 5 aa, Artificial Sequence
  CDR sequence
INAMG

SEQ ID NO: 347 - protein, 5 aa, Artificial Sequence
  CDR sequence
DYAIG

SEQ ID NO: 348 - protein, 5 aa, Artificial Sequence
  CDR sequence
INAMG

SEQ ID NO: 349 - protein, 5 aa, Artificial Sequence
  CDR sequence
INAMG

SEQ ID NO: 350 - protein, 5 aa, Artificial Sequence
  CDR sequence
IKAMG

SEQ ID NO: 351 - protein, 5 aa, Artificial Sequence
  CDR sequence
DYAIG

SEQ ID NO: 352 - protein, 5 aa, Artificial Sequence
  CDR sequence
DYAIG

SEQ ID NO: 353 - protein, 5 aa, Artificial Sequence
  CDR sequence
INAMG

SEQ ID NO: 354 - protein, 5 aa, Artificial Sequence
  CDR sequence
DYAIG

SEQ ID NO: 355 - protein, 5 aa, Artificial Sequence
  CDR sequence
INAMG

SEQ ID NO: 356 - protein, 5 aa, Artificial Sequence
  CDR sequence
INAMG

SEQ ID NO: 357 - protein, 5 aa, Artificial Sequence
  CDR sequence
INAMG

SEQ ID NO: 358 - protein, 5 aa, Artificial Sequence
  CDR sequence
DMFMG

SEQ ID NO: 359 - protein, 5 aa, Artificial Sequence
  CDR sequence
MHRMG

SEQ ID NO: 360 - protein, 5 aa, Artificial Sequence
  CDR sequence
INAMG

SEQ ID NO: 361 - protein, 5 aa, Artificial Sequence
  CDR sequence
INAMG

SEQ ID NO: 362 - protein, 5 aa, Artificial Sequence
  CDR sequence
INAMG

SEQ ID NO: 363 - protein, 5 aa, Artificial Sequence
  CDR sequence
SYAMS

SEQ ID NO: 364 - protein, 5 aa, Artificial Sequence
  CDR sequence
INAMG

SEQ ID NO: 365 - protein, 5 aa, Artificial Sequence
  CDR sequence
DYDMG

SEQ ID NO: 366 - protein, 2 aa, Artificial Sequence
  CDR sequence
MA

SEQ ID NO: 367 - protein, 5 aa, Artificial Sequence
  CDR sequence
DYDMG

SEQ ID NO: 368 - protein, 5 aa, Artificial Sequence
  CDR sequence
DYDMG

SEQ ID NO: 369 - protein, 5 aa, Artificial Sequence
  CDR sequence
DYDIG

SEQ ID NO: 370 - protein, 5 aa, Artificial Sequence
  CDR sequence
DYDIG

SEQ ID NO: 371 - protein, 5 aa, Artificial Sequence
  CDR sequence
NFPMG

SEQ ID NO: 372 - protein, 5 aa, Artificial Sequence
  CDR sequence
DYDMG

SEQ ID NO: 373 - protein, 5 aa, Artificial Sequence
  CDR sequence
INAMY

SEQ ID NO: 374 - protein, 5 aa, Artificial Sequence
  CDR sequence
DDTMA

SEQ ID NO: 375 - protein, 5 aa, Artificial Sequence
  CDR sequence
DDTMA

SEQ ID NO: 376 - protein, 5 aa, Artificial Sequence
  CDR sequence
DDTMA

SEQ ID NO: 377 - protein, 5 aa, Artificial Sequence
  CDR sequence
DDTMA

SEQ ID NO: 378 - protein, 5 aa, Artificial Sequence
  CDR sequence
DDTMA

SEQ ID NO: 379 - protein, 5 aa, Artificial Sequence
  CDR sequence
DDTMA

SEQ ID NO: 380 - protein, 5 aa, Artificial Sequence
  CDR sequence
DDTMA

SEQ ID NO: 381 - protein, 5 aa, Artificial Sequence
  CDR sequence
DYAMG

SEQ ID NO: 382 - protein, 5 aa, Artificial Sequence
  CDR sequence
DDTMA

SEQ ID NO: 383 - protein, 5 aa, Artificial Sequence
  CDR sequence
TASVG

SEQ ID NO: 384 - protein, 5 aa, Artificial Sequence
  CDR sequence
GNAMG

SEQ ID NO: 385 - protein, 5 aa, Artificial Sequence
  CDR sequence
DRAMG

SEQ ID NO: 386 - protein, 5 aa, Artificial Sequence
  CDR sequence
DNAMG

SEQ ID NO: 387 - protein, 14 aa, Artificial Sequence
  Framework sequence
WFRQAPGKERVFVA

SEQ ID NO: 388 - protein, 14 aa, Artificial Sequence
  Framework sequence
WFRQAPGKEREFVS

SEQ ID NO: 389 - protein, 14 aa, Artificial Sequence
  Framework sequence
WFRQAPGKEREFVS

SEQ ID NO: 390 - protein, 14 aa, Artificial Sequence
  Framework sequence
WFRQAPGKERVFVA

SEQ ID NO: 391 - protein, 14 aa, Artificial Sequence
  Framework sequence
WFRQAPGKEREFVA

SEQ ID NO: 392 - protein, 14 aa, Artificial Sequence
  Framework sequence
WFRQAPGKEREVVA

SEQ ID NO: 393 - protein, 14 aa, Artificial Sequence
  Framework sequence
WFRQAPGKEREFVA

SEQ ID NO: 394 - protein, 14 aa, Artificial Sequence
  Framework sequence
WFRQAPGKERECVA

SEQ ID NO: 395 - protein, 14 aa, Artificial Sequence
  Framework sequence
WFRQAPGKEREGVS

SEQ ID NO: 396 - protein, 14 aa, Artificial Sequence
  Framework sequence
WFRQAPGKEREVVA

SEQ ID NO: 397 - protein, 14 aa, Artificial Sequence
  Framework sequence
WYRQAPGKQRELVA

SEQ ID NO: 398 - protein, 14 aa, Artificial Sequence
  Framework sequence
WYRQAPGKQRELVA

SEQ ID NO: 399 - protein, 14 aa, Artificial Sequence
  Framework sequence
WFRQAPGKERECVA

SEQ ID NO: 400 - protein, 14 aa, Artificial Sequence
  Framework sequence
WFRQAPGKEREGVS

SEQ ID NO: 401 - protein, 14 aa, Artificial Sequence
  Framework sequence
WFRQAPGKERECVA

SEQ ID NO: 402 - protein, 14 aa, Artificial Sequence
  Framework sequence
WFRQAPGKEREGVS

SEQ ID NO: 403 - protein, 14 aa, Artificial Sequence
  Framework sequence
WFRQAPGKERECVA

SEQ ID NO: 404 - protein, 14 aa, Artificial Sequence
  Framework sequence
WFRQAPGKEREGVS

SEQ ID NO: 405 - protein, 14 aa, Artificial Sequence
  Framework sequence
WFRQAPGKEREGVS

SEQ ID NO: 406 - protein, 14 aa, Artificial Sequence
  Framework sequence
WFRQAPGKEREGVS

SEQ ID NO: 407 - protein, 14 aa, Artificial Sequence
  Framework sequence
WFRQAPGKEREGVS

SEQ ID NO: 408 - protein, 14 aa, Artificial Sequence
  Framework sequence
WYRQAPGKQRELVA

SEQ ID NO: 409 - protein, 14 aa, Artificial Sequence
  Framework sequence
WFRQAPGKEREGVS

SEQ ID NO: 410 - protein, 14 aa, Artificial Sequence
  Framework sequence
WFRQAPGKEREGVS

SEQ ID NO: 411 - protein, 14 aa, Artificial Sequence
  Framework sequence
WYRQAPGKQRELVA

SEQ ID NO: 412 - protein, 14 aa, Artificial Sequence
  Framework sequence
WFRQAPGKERECVA

SEQ ID NO: 413 - protein, 14 aa, Artificial Sequence
  Framework sequence
WFRQAPGKEREGVS

SEQ ID NO: 414 - protein, 14 aa, Artificial Sequence
  Framework sequence
WFRQAPGKEREGVS

SEQ ID NO: 415 - protein, 14 aa, Artificial Sequence
  Framework sequence
WFRQAPGKEREVVA

SEQ ID NO: 416 - protein, 14 aa, Artificial Sequence
  Framework sequence
WYRQAPGKQRDFLA

SEQ ID NO: 417 - protein, 14 aa, Artificial Sequence
  Framework sequence
WYRQVPGKQRELVA

SEQ ID NO: 418 - protein, 14 aa, Artificial Sequence
  Framework sequence
WYRQVPGKQRELVA

SEQ ID NO: 419 - protein, 14 aa, Artificial Sequence
  Framework sequence
WFRQAPGKEHESVS

SEQ ID NO: 420 - protein, 14 aa, Artificial Sequence
  Framework sequence
WYCQAPGKQRELVA

SEQ ID NO: 421 - protein, 14 aa, Artificial Sequence
  Framework sequence
WYRQAPGAQREFVA

SEQ ID NO: 422 - protein, 14 aa, Artificial Sequence
  Framework sequence
WFRQAPGKEREFVA

SEQ ID NO: 423 - protein, 14 aa, Artificial Sequence
  Framework sequence
WFRQAPGKEREFVA

SEQ ID NO: 424 - protein, 14 aa, Artificial Sequence
  Framework sequence
WFRQAPGKEREFVA

SEQ ID NO: 425 - protein, 14 aa, Artificial Sequence
  Framework sequence
WFRQAPGKEREFVA

SEQ ID NO: 426 - protein, 14 aa, Artificial Sequence
  Framework sequence
WHRQAPGKQRESVA

SEQ ID NO: 427 - protein, 14 aa, Artificial Sequence
  Framework sequence
WFRQAPGKEREFVA

SEQ ID NO: 428 - protein, 14 aa, Artificial Sequence
  Framework sequence
WFRQAPGKEREGVS

SEQ ID NO: 429 - protein, 14 aa, Artificial Sequence
  Framework sequence
WFRQAPGKERECVA

SEQ ID NO: 430 - protein, 14 aa, Artificial Sequence
  Framework sequence
WFRQAPGKEREFVA

SEQ ID NO: 431 - protein, 14 aa, Artificial Sequence
  Framework sequence
WYRQAPGKQRELVA

SEQ ID NO: 432 - protein, 14 aa, Artificial Sequence
  Framework sequence
WFRQAPGKEREGVS

SEQ ID NO: 433 - protein, 14 aa, Artificial Sequence
  Framework sequence
WYRQAPGEQRELVA

SEQ ID NO: 434 - protein, 14 aa, Artificial Sequence
  Framework sequence
WYRQAPGKQRELVA

SEQ ID NO: 435 - protein, 14 aa, Artificial Sequence
  Framework sequence
WYRQAPGKQRELVA

SEQ ID NO: 436 - protein, 14 aa, Artificial Sequence
  Framework sequence
WFRQAPGKEREGVS

SEQ ID NO: 437 - protein, 14 aa, Artificial Sequence
  Framework sequence
WFRQAPGKEREGVS

SEQ ID NO: 438 - protein, 14 aa, Artificial Sequence
  Framework sequence
WYRQAPGKQRELVA

SEQ ID NO: 439 - protein, 14 aa, Artificial Sequence
  Framework sequence
WFRQAPGKEREGVS

SEQ ID NO: 440 - protein, 14 aa, Artificial Sequence
  Framework sequence
WYRQAPGKQRELVA

SEQ ID NO: 441 - protein, 14 aa, Artificial Sequence
  Framework sequence
WYRQAPGKQRELVA

SEQ ID NO: 442 - protein, 14 aa, Artificial Sequence
  Framework sequence
WYRQAPGQQREWVA

SEQ ID NO: 443 - protein, 14 aa, Artificial Sequence
  Framework sequence
WFRQAPGKSRESVA

SEQ ID NO: 444 - protein, 14 aa, Artificial Sequence
  Framework sequence
WFRQAPGKEREFVA

SEQ ID NO: 445 - protein, 14 aa, Artificial Sequence
  Framework sequence
WHRQAPGQQREWVA

SEQ ID NO: 446 - protein, 14 aa, Artificial Sequence
  Framework sequence
WYRQAPGKQRDFLA

SEQ ID NO: 447 - protein, 14 aa, Artificial Sequence
  Framework sequence
WYRQAPGKQRDFLA

SEQ ID NO: 448 - protein, 14 aa, Artificial Sequence
  Framework sequence
WVRRAPGKGLEWVS

SEQ ID NO: 449 - protein, 14 aa, Artificial Sequence
  Framework sequence
WYRQAPGQQREWVA

SEQ ID NO: 450 - protein, 14 aa, Artificial Sequence
  Framework sequence
WFRQAPGKERECVA

SEQ ID NO: 451 - protein, 14 aa, Artificial Sequence
  Framework sequence
WFRQAPGKEREFVA

SEQ ID NO: 452 - protein, 14 aa, Artificial Sequence
  Framework sequence
WFRQAPGKERECVA

SEQ ID NO: 453 - protein, 14 aa, Artificial Sequence
  Framework sequence
WFRQAPGKERECVA

SEQ ID NO: 454 - protein, 14 aa, Artificial Sequence
  Framework sequence
WFRQAPGKEREGVS

SEQ ID NO: 455 - protein, 14 aa, Artificial Sequence
  Framework sequence
WFRQAPGKEREGVS

SEQ ID NO: 456 - protein, 14 aa, Artificial Sequence
  Framework sequence
WFRQRPGEEREYVA

SEQ ID NO: 457 - protein, 14 aa, Artificial Sequence
  Framework sequence
WFRQAPGKERECVA

SEQ ID NO: 458 - protein, 14 aa, Artificial Sequence
  Framework sequence
WHRQAPGKQRESVA

SEQ ID NO: 459 - protein, 14 aa, Artificial Sequence
  Framework sequence
WFRQAPGKEREFVA

SEQ ID NO: 460 - protein, 14 aa, Artificial Sequence
  Framework sequence
WFRQAPGKEREFVA

SEQ ID NO: 461 - protein, 14 aa, Artificial Sequence
  Framework sequence
WFRQAPGKEREFVA

SEQ ID NO: 462 - protein, 14 aa, Artificial Sequence
  Framework sequence
WFRQAPGKEREFVA

SEQ ID NO: 463 - protein, 14 aa, Artificial Sequence
  Framework sequence
WFRQAPGKEREFVA

SEQ ID NO: 464 - protein, 14 aa, Artificial Sequence
  Framework sequence
WFRQAPGKEREFVA

SEQ ID NO: 465 - protein, 14 aa, Artificial Sequence
  Framework sequence
WFRQAPGKEREFVA

SEQ ID NO: 466 - protein, 14 aa, Artificial Sequence
  Framework sequence
WFRQAPGKEREFVA

SEQ ID NO: 467 - protein, 14 aa, Artificial Sequence
  Framework sequence
WFRQAPGKEREFVA

SEQ ID NO: 468 - protein, 14 aa, Artificial Sequence
  Framework sequence
WFRQAPGKQREWVV

SEQ ID NO: 469 - protein, 14 aa, Artificial Sequence
  Framework sequence
WFRQAPGTEREFVA

SEQ ID NO: 470 - protein, 14 aa, Artificial Sequence
  Framework sequence
WYRQAPGKQREMVA

SEQ ID NO: 471 - protein, 14 aa, Artificial Sequence
  Framework sequence
WYRQYPGKQREWVA

SEQ ID NO: 472 - protein, 17 aa, Artificial Sequence
  CDR sequence
GISWSTGIAHYTDSVKG

SEQ ID NO: 473 - protein, 16 aa, Artificial Sequence
  CDR sequence
GIDWRGNIVDAESVKG

SEQ ID NO: 474 - protein, 16 aa, Artificial Sequence
  CDR sequence
GIDWRGNIVDAESVKG

SEQ ID NO: 475 - protein, 17 aa, Artificial Sequence
  CDR sequence
GISWSTGIAHYTDSVKG

SEQ ID NO: 476 - protein, 14 aa, Artificial Sequence
  CDR sequence
AIAYATHFADSVKG

SEQ ID NO: 477 - protein, 17 aa, Artificial Sequence
  CDR sequence
IIDTNGDNTLTVGSVKG

SEQ ID NO: 478 - protein, 14 aa, Artificial Sequence
  CDR sequence
AIAYATHFADSVKG

SEQ ID NO: 479 - protein, 17 aa, Artificial Sequence
  CDR sequence
IIDTNGDNTLIVGSVKG

SEQ ID NO: 480 - protein, 17 aa, Artificial Sequence
  CDR sequence
SISSNDGSTFYADSVKG

SEQ ID NO: 481 - protein, 17 aa, Artificial Sequence
  CDR sequence
IIDTNGDNTLTVGSVKG

SEQ ID NO: 482 - protein, 16 aa, Artificial Sequence
  CDR sequence
AAISGGSTNYADFVKG

SEQ ID NO: 483 - protein, 16 aa, Artificial Sequence
  CDR sequence
RITSGGSTVYADSVKG

SEQ ID NO: 484 - protein, 17 aa, Artificial Sequence
  CDR sequence
IIDTNGDNTLIVGSVKG

SEQ ID NO: 485 - protein, 17 aa, Artificial Sequence
  CDR sequence
SISSSNGNTYYADSVRG

SEQ ID NO: 486 - protein, 17 aa, Artificial Sequence
  CDR sequence
IIDTNGDNTLIVGSVKG

SEQ ID NO: 487 - protein, 17 aa, Artificial Sequence
  CDR sequence
SISSSNGNTYYADSVRG

SEQ ID NO: 488 - protein, 17 aa, Artificial Sequence
  CDR sequence
IIDTNGDNTLIVGSVKG

SEQ ID NO: 489 - protein, 17 aa, Artificial Sequence
  CDR sequence
SISSSNGNTYYADSVRG

SEQ ID NO: 490 - protein, 17 aa, Artificial Sequence
  CDR sequence
SISSSNGNTYYADSVRG

SEQ ID NO: 491 - protein, 17 aa, Artificial Sequence
  CDR sequence
SISSSNGNTYYADSVRG

SEQ ID NO: 492 - protein, 17 aa, Artificial Sequence
  CDR sequence
SISSSNGNTYYADSVRG

SEQ ID NO: 493 - protein, 16 aa, Artificial Sequence
  CDR sequence
RITSGGSTYYADSVKG

SEQ ID NO: 494 - protein, 17 aa, Artificial Sequence
  CDR sequence
CISSSDGSTYYASSVKG

SEQ ID NO: 495 - protein, 17 aa, Artificial Sequence
  CDR sequence
CISSTDGSTYYADSVKG

SEQ ID NO: 496 - protein, 16 aa, Artificial Sequence
  CDR sequence
AAISGGSTNYADFVKG

SEQ ID NO: 497 - protein, 17 aa, Artificial Sequence
  CDR sequence
IIDTNGDNTLIVGSVKG

SEQ ID NO: 498 - protein, 17 aa, Artificial Sequence
  CDR sequence
SISSSNGNTYYADSVRG

SEQ ID NO: 499 - protein, 17 aa, Artificial Sequence
  CDR sequence
SISSSNGNTYYADSVRG

SEQ ID NO: 500 - protein, 17 aa, Artificial Sequence
  CDR sequence
IIDTNGDNTLTVGSVKG

SEQ ID NO: 501 - protein, 16 aa, Artificial Sequence
  CDR sequence
VITDGDKTLYADSVKG

SEQ ID NO: 502 - protein, 16 aa, Artificial Sequence
  CDR sequence
TVRSGSITNYADSVQD

SEQ ID NO: 503 - protein, 16 aa, Artificial Sequence
  CDR sequence
TVRSGSITNYADSVQD

SEQ ID NO: 504 - protein, 17 aa, Artificial Sequence
  CDR sequence
AISSDGGSEYYAGSVKG

SEQ ID NO: 505 - protein, 16 aa, Artificial Sequence
  CDR sequence
SISSGGGINYADSVKG

SEQ ID NO: 506 - protein, 16 aa, Artificial Sequence
  CDR sequence
GVGLDGTPNYADSVKG

SEQ ID NO: 507 - protein, 17 aa, Artificial Sequence
  CDR sequence
IIRGNPSRTYHSDSVKG

SEQ ID NO: 508 - protein, 17 aa, Artificial Sequence
  CDR sequence
TITFSGARTHYSDSVRD

SEQ ID NO: 509 - protein, 17 aa, Artificial Sequence
  CDR sequence
IIRGNPSRTYHSDSVKG

SEQ ID NO: 510 - protein, 17 aa, Artificial Sequence
  CDR sequence
SILWDGSITYYADSVKD

SEQ ID NO: 511 - protein, 16 aa, Artificial Sequence
  CDR sequence
SITSGGMRNYADSVKD

SEQ ID NO: 512 - protein, 17 aa, Artificial Sequence
  CDR sequence
VIDTNGGHTLTVGSVKG

SEQ ID NO: 513 - protein, 17 aa, Artificial Sequence
  CDR sequence
SISSSNGNTYYADSVRG

SEQ ID NO: 514 - protein, 17 aa, Artificial Sequence
  CDR sequence
IIDTNGDNTLIVGSVKG

SEQ ID NO: 515 - protein, 14 aa, Artificial Sequence
  CDR sequence
AIAYATHFADSVKG

SEQ ID NO: 516 - protein, 16 aa, Artificial Sequence
  CDR sequence
SITSGGSTTYADSVKG

SEQ ID NO: 517 - protein, 17 aa, Artificial Sequence
  CDR sequence
SISSSNGNTYYADSVRG

SEQ ID NO: 518 - protein, 16 aa, Artificial Sequence
  CDR sequence
AAISGGSTNYADFVKG

SEQ ID NO: 519 - protein, 16 aa, Artificial Sequence
  CDR sequence
AAISGGSTNYADFVKG

SEQ ID NO: 520 - protein, 16 aa, Artificial Sequence
  CDR sequence
RITSGGSTYYADSVKG

SEQ ID NO: 521 - protein, 17 aa, Artificial Sequence
  CDR sequence
SISSSNGNTYYADSVRG

SEQ ID NO: 522 - protein, 17 aa, Artificial Sequence
  CDR sequence
SISSSNGNTYYADSVRG

SEQ ID NO: 523 - protein, 16 aa, Artificial Sequence
  CDR sequence
AAISGGSTNYADFVKG

SEQ ID NO: 524 - protein, 17 aa, Artificial Sequence
  CDR sequence
CMISSDGSTYYADSVKG

SEQ ID NO: 525 - protein, 16 aa, Artificial Sequence
  CDR sequence
AAISGGSTNYADFVKG

SEQ ID NO: 526 - protein, 16 aa, Artificial Sequence
  CDR sequence
AAISGGSTNYADFVKG

SEQ ID NO: 527 - protein, 16 aa, Artificial Sequence
  CDR sequence
VITDTDSTIYPDSVKG

SEQ ID NO: 528 - protein, 16 aa, Artificial Sequence
  CDR sequence
RISPSGNTFYQDSVRG

SEQ ID NO: 529 - protein, 17 aa, Artificial Sequence
  CDR sequence
RIFTDDGDSYYADSVQG

SEQ ID NO: 530 - protein, 16 aa, Artificial Sequence
  CDR sequence
VITDTDSTIYPDSVKG

SEQ ID NO: 531 - protein, 16 aa, Artificial Sequence
  CDR sequence
VITDGDKTLYADSVKG

SEQ ID NO: 532 - protein, 16 aa, Artificial Sequence
  CDR sequence
IITDGSKTLYADSVKG

SEQ ID NO: 533 - protein, 17 aa, Artificial Sequence
  CDR sequence
AINSDGTGSSYAPFVTG

SEQ ID NO: 534 - protein, 16 aa, Artificial Sequence
  CDR sequence
VITDTDSTIYPDSVKG

SEQ ID NO: 535 - protein, 17 aa, Artificial Sequence
  CDR sequence
VIDTNGDNTLTVGSVKG

SEQ ID NO: 536 - protein, 14 aa, Artificial Sequence
  CDR sequence
AISIVTDYADSVKG

SEQ ID NO: 537 - protein, 17 aa, Artificial Sequence
  CDR sequence
VIDTNGDNTLTVGSVKG

SEQ ID NO: 538 - protein, 17 aa, Artificial Sequence
  CDR sequence
VIDTNGDNTLTVGSVKG

SEQ ID NO: 539 - protein, 17 aa, Artificial Sequence
  CDR sequence
GISSSDGNTYYADSVKG

SEQ ID NO: 540 - protein, 17 aa, Artificial Sequence
  CDR sequence
GISSSDGNTYYADSVKG

SEQ ID NO: 541 - protein, 17 aa, Artificial Sequence
  CDR sequence
VISWNNNYIHYRDSVKG

SEQ ID NO: 542 - protein, 17 aa, Artificial Sequence
  CDR sequence
VIDTNGDNTLTVGSVKG

SEQ ID NO: 543 - protein, 16 aa, Artificial Sequence
  CDR sequence
SITSGGMRNYADSVKD

SEQ ID NO: 544 - protein, 17 aa, Artificial Sequence
  CDR sequence
TITFSGARTHYSDSVRD

SEQ ID NO: 545 - protein, 17 aa, Artificial Sequence
  CDR sequence
IITFNGARTHYSDSVRD

SEQ ID NO: 546 - protein, 17 aa, Artificial Sequence
  CDR sequence
TITFSGARTHYSDSVRD

SEQ ID NO: 547 - protein, 17 aa, Artificial Sequence
  CDR sequence
TITFSGARTHYSDSVRD

SEQ ID NO: 548 - protein, 17 aa, Artificial Sequence
  CDR sequence
TITFSGARTHYSDSVRD

SEQ ID NO: 549 - protein, 17 aa, Artificial Sequence
  CDR sequence
IITFNGARTHYSDSVRD

SEQ ID NO: 550 - protein, 17 aa, Artificial Sequence
  CDR sequence
TITFSGARTHYSDSVRD

SEQ ID NO: 551 - protein, 17 aa, Artificial Sequence
  CDR sequence
VISWSGAYTEYADSVKG

SEQ ID NO: 552 - protein, 17 aa, Artificial Sequence
  CDR sequence
TITFSGARTHYSDSVRD

SEQ ID NO: 553 - protein, 16 aa, Artificial Sequence
  CDR sequence
GISSGGSTHYADSVKG

SEQ ID NO: 554 - protein, 17 aa, Artificial Sequence
  CDR sequence
AITWSGDMSVYAEFVKG

SEQ ID NO: 555 - protein, 16 aa, Artificial Sequence
  CDR sequence
GVSRGGMTSYADSVKG

SEQ ID NO: 556 - protein, 16 aa, Artificial Sequence
  CDR sequence
GISRGGTTGYTDSVKG

SEQ ID NO: 557 - protein, 32 aa, Artificial Sequence
  Framework sequence
RFTISRDNAKNTGSLQMNSLKPEDTAVYYCAV

SEQ ID NO: 558 - protein, 32 aa, Artificial Sequence
  Framework sequence
RFTISRENAKNTLYLQMNHLKPEDTAVYYCAA

SEQ ID NO: 559 - protein, 32 aa, Artificial Sequence; identical to SEQ ID NO: 558
  Framework sequence

SEQ ID NO: 560 - protein, 32 aa, Artificial Sequence; identical to SEQ ID NO: 557
  Framework sequence

SEQ ID NO: 561 - protein, 32 aa, Artificial Sequence
  Framework sequence
RFTISRGNAKNTVYLQMNSLKPEDTAVYYCAA

SEQ ID NO: 562 - protein, 32 aa, Artificial Sequence
  Framework sequence
RFAISSDNAKNTVYLQMNSLLPEDTAVYTCAA

SEQ ID NO: 563 - protein, 32 aa, Artificial Sequence
  Framework sequence
RFTISRGNAKNTVYLQMNSLKPEDAAVYYCAA

SEQ ID NO: 564 - protein, 32 aa, Artificial Sequence; identical to SEQ ID NO: 562
  Framework sequence

SEQ ID NO: 565 - protein, 32 aa, Artificial Sequence
  Framework sequence
RFTISRDKAKNTVYLQMNSLKPEDTAVYYCAA

SEQ ID NO: 566 - protein, 32 aa, Artificial Sequence; identical to SEQ ID NO: 562
  Framework sequence

SEQ ID NO: 567 - protein, 32 aa, Artificial Sequence
  Framework sequence
RFTISRDNAKNTVYLQMNSLKPEDTAVYYCNA

SEQ ID NO: 568 - protein, 32 aa, Artificial Sequence
  Framework sequence
RFTISRDNAKNTVYLQMNSLKPEDATVYYCNA

SEQ ID NO: 569 - protein, 32 aa, Artificial Sequence; identical to SEQ ID NO: 562
  Framework sequence

SEQ ID NO: 570 - protein, 32 aa, Artificial Sequence
  Framework sequence
RFTISSDNAKNTVYLQMNSLKPEDTGVYYCAA

SEQ ID NO: 571 - protein, 32 aa, Artificial Sequence; identical to SEQ ID NO: 562
  Framework sequence

SEQ ID NO: 572 - protein, 32 aa, Artificial Sequence
  Framework sequence
RFTISSDNAKNTVYLQMNSLKPEDAGVYYCAA

SEQ ID NO: 573 - protein, 32 aa, Artificial Sequence; identical to SEQ ID NO: 562
  Framework sequence

SEQ ID NO: 574 - protein, 32 aa, Artificial Sequence; identical to SEQ ID NO: 570
  Framework sequence

SEQ ID NO: 575 - protein, 32 aa, Artificial Sequence; identical to SEQ ID NO: 570
  Framework sequence

SEQ ID NO: 576 - protein, 32 aa, Artificial Sequence; identical to SEQ ID NO: 570
  Framework sequence

SEQ ID NO: 577 - protein, 32 aa, Artificial Sequence; identical to SEQ ID NO: 570
  Framework sequence

SEQ ID NO: 578 - protein, 32 aa, Artificial Sequence
  Framework sequence
RFTISRDNAKNTVYLQMNSLKPEDTAVFYCNA

SEQ ID NO: 579 - protein, 32 aa, Artificial Sequence
  Framework sequence
RFTVSRDKAKNTVYLQMNSLKPEDTAVYYCAF

SEQ ID NO: 580 - protein, 32 aa, Artificial Sequence
  Framework sequence
RFTISRDNAKNTVYLQMNSLNPEDTGVYTCAA

SEQ ID NO: 581 - protein, 32 aa, Artificial Sequence; identical to SEQ ID NO: 567
  Framework sequence

SEQ ID NO: 582 - protein, 32 aa, Artificial Sequence; identical to SEQ ID NO: 562
  Framework sequence

SEQ ID NO: 583 - protein, 32 aa, Artificial Sequence; identical to SEQ ID NO: 570
  Framework sequence

SEQ ID NO: 584 - protein, 32 aa, Artificial Sequence; identical to SEQ ID NO: 570
  Framework sequence

SEQ ID NO: 585 - protein, 32 aa, Artificial Sequence; identical to SEQ ID NO: 562
  Framework sequence

SEQ ID NO: 586 - protein, 32 aa, Artificial Sequence
  Framework sequence
RFTISNDNAKNTVYLQMNSLKPEDTAVYYCNA

SEQ ID NO: 587 - protein, 32 aa, Artificial Sequence
  Framework sequence
QFTITRDIDENTVYLQMNSLKPEDTAVYYCLT

SEQ ID NO: 588 - protein, 32 aa, Artificial Sequence
  Framework sequence
RFTITRDIDENTVYLQMNSLKPEDTAVYYCLT

SEQ ID NO: 589 - protein, 32 aa, Artificial Sequence; identical to SEQ ID NO: 112
  Framework sequence

SEQ ID NO: 590 - protein, 32 aa, Artificial Sequence
  Framework sequence
RFTISRDYAENSVDLQMNSLKPEDTAVYYCNA

SEQ ID NO: 591 - protein, 32 aa, Artificial Sequence
  Framework sequence
RFTISRDNTKNTVSLQMENLKPEDTGVYYCNI

SEQ ID NO: 592 - protein, 32 aa, Artificial Sequence
  Framework sequence
RFTASRDNAKNTVYLQMNRLEPEDTAVYYCAA

SEQ ID NO: 593 - protein, 32 aa, Artificial Sequence
  Framework sequence
RFTISRDNAKNTVYLQMDSLKSEDTAVYYCAA

SEQ ID NO: 594 - protein, 32 aa, Artificial Sequence; identical to SEQ ID NO: 592
  Framework sequence

SEQ ID NO: 595 - protein, 32 aa, Artificial Sequence
  Framework sequence
RFTISRDISRKTLYLQMNSLRPEDTATYTCAR

SEQ ID NO: 596 - protein, 32 aa, Artificial Sequence
  Framework sequence
RFTISKDNAKNTVYLQMNGLKPDDTAVYYCGL

SEQ ID NO: 597 - protein, 32 aa, Artificial Sequence
  Framework sequence
RFAISSDNAKNTVYLQMNSLVPEDTAVYTCAA

SEQ ID NO: 598 - protein, 32 aa, Artificial Sequence; identical to SEQ ID NO: 570
  Framework sequence

SEQ ID NO: 599 - protein, 32 aa, Artificial Sequence; identical to SEQ ID NO: 562
  Framework sequence

SEQ ID NO: 600 - protein, 32 aa, Artificial Sequence; identical to SEQ ID NO: 561
  Framework sequence

SEQ ID NO: 601 - protein, 32 aa, Artificial Sequence
  Framework sequence
RFTISRDNAKDTVYLQMNSLKPEDTAVYYCNA

SEQ ID NO: 602 - protein, 32 aa, Artificial Sequence; identical to SEQ ID NO: 570
  Framework sequence

SEQ ID NO: 603 - protein, 32 aa, Artificial Sequence; identical to SEQ ID NO: 567
  Framework sequence

SEQ ID NO: 604 - protein, 32 aa, Artificial Sequence; identical to SEQ ID NO: 567
  Framework sequence

SEQ ID NO: 605 - protein, 32 aa, Artificial Sequence; identical to SEQ ID NO: 578
  Framework sequence

SEQ ID NO: 606 - protein, 32 aa, Artificial Sequence
  Framework sequence
RFTISSDNAKNTVYLQMNGLKPEDTGVYYCAA

SEQ ID NO: 607 - protein, 32 aa, Artificial Sequence; identical to SEQ ID NO: 572
  Framework sequence

SEQ ID NO: 608 - protein, 32 aa, Artificial Sequence; identical to SEQ ID NO: 567
  Framework sequence

SEQ ID NO: 609 - protein, 32 aa, Artificial Sequence
  Framework sequence
RFTISSDNAKNTVYLQMDSLKPEDTAVYYCAA

SEQ ID NO: 610 - protein, 32 aa, Artificial Sequence
  Framework sequence
RFTISRDNAKNTVYLQMNSLKPGDTAVYYCNA

SEQ ID NO: 611 - protein, 32 aa, Artificial Sequence; identical to SEQ ID NO: 567
  Framework sequence

SEQ ID NO: 612 - protein, 32 aa, Artificial Sequence
  Framework sequence
RFAISRDGAKNTVHLRMSSLKPEDTAVYYCNA

SEQ ID NO: 613 - protein, 32 aa, Artificial Sequence
  Framework sequence
RFTISTDNAKNTVYLQMNNLKPEDTAVYYCAA

SEQ ID NO: 614 - protein, 32 aa, Artificial Sequence
  Framework sequence
RFTISGDNAKNTVYLQMNSLKPEDTGVYFCAA

SEQ ID NO: 615 - protein, 32 aa, Artificial Sequence; identical to SEQ ID NO: 612
  Framework sequence

SEQ ID NO: 616 - protein, 32 aa, Artificial Sequence; identical to SEQ ID NO: 586
  Framework sequence

SEQ ID NO: 617 - protein, 32 aa, Artificial Sequence; identical to SEQ ID NO: 586
  Framework sequence

SEQ ID NO: 618 - protein, 32 aa, Artificial Sequence
  Framework sequence
RFTASRDNAKNTLYLQMNSLKPEDTAVYYCTN

SEQ ID NO: 619 - protein, 32 aa, Artificial Sequence; identical to SEQ ID NO: 612
  Framework sequence

SEQ ID NO: 620 - protein, 32 aa, Artificial Sequence
  Framework sequence
RFAISRDNAKNTVYLQMNSLLPEDTAVYTCAA

SEQ ID NO: 621 - protein, 32 aa, Artificial Sequence
  Framework sequence
RFNISRDNRENTVYLQMNSLKPEDTAVYYCAA

SEQ ID NO: 622 - protein, 32 aa, Artificial Sequence; identical to SEQ ID NO: 620
  Framework sequence

SEQ ID NO: 623 - protein, 32 aa, Artificial Sequence; identical to SEQ ID NO: 620
  Framework sequence

SEQ ID NO: 624 - protein, 32 aa, Artificial Sequence
  Framework sequence
RFTISSDNAKNTVYLQMNSLKPEDTAVYYCAA

SEQ ID NO: 625 - protein, 32 aa, Artificial Sequence; identical to SEQ ID NO: 624
  Framework sequence

SEQ ID NO: 626 - protein, 32 aa, Artificial Sequence
  Framework sequence
RFTASRDTSENRMYLQMNGLKPEDTAVYYCAA

SEQ ID NO: 627 - protein, 32 aa, Artificial Sequence; identical to SEQ ID NO: 620
  Framework sequence

SEQ ID NO: 628 - protein, 32 aa, Artificial Sequence; identical to SEQ ID NO: 596
  Framework sequence

SEQ ID NO: 629 - protein, 32 aa, Artificial Sequence
  Framework sequence
RFTISRDNAKNTVYLQMNSLKSEDTAVYYCAA

SEQ ID NO: 630 - protein, 32 aa, Artificial Sequence; identical to SEQ ID NO: 629
  Framework sequence

SEQ ID NO: 631 - protein, 32 aa, Artificial Sequence; identical to SEQ ID NO: 629
  Framework sequence

SEQ ID NO: 632 - protein, 32 aa, Artificial Sequence; identical to SEQ ID NO: 629
  Framework sequence

SEQ ID NO: 633 - protein, 32 aa, Artificial Sequence; identical to SEQ ID NO: 629
  Framework sequence

SEQ ID NO: 634 - protein, 32 aa, Artificial Sequence; identical to SEQ ID NO: 629
  Framework sequence

SEQ ID NO: 635 - protein, 32 aa, Artificial Sequence; identical to SEQ ID NO: 629
  Framework sequence

SEQ ID NO: 636 - protein, 32 aa, Artificial Sequence
  Framework sequence
RFTISRNNAANTGALQMNSLKLEDTAVYYCAA

SEQ ID NO: 637 - protein, 32 aa, Artificial Sequence; identical to SEQ ID NO: 629
  Framework sequence

SEQ ID NO: 638 - protein, 32 aa, Artificial Sequence
  Framework sequence
RFISSQDDAKNTVYLQMNSLKPEDTAIYYCAI

SEQ ID NO: 639 - protein, 32 aa, Artificial Sequence
  Framework sequence
RFTVSRDNAKSVVYLQMNRLKPEDTSVYYCAG

SEQ ID NO: 640 - protein, 32 aa, Artificial Sequence
  Framework sequence
RLTISRDNAKNSVYLQMNSLNPEDTAVYYCSA

SEQ ID NO: 641 - protein, 32 aa, Artificial Sequence
  Framework sequence
RFTISRDNAKNTVYLQMNSLKPEDTAVYYCAI

SEQ ID NO: 642 - protein, 10 aa, Artificial Sequence
  CDR sequence
VQTTKGNYDY

SEQ ID NO: 643 - protein, 15 aa, Artificial Sequence
  CDR sequence
SSVFSDLRYRKNPKY

SEQ ID NO: 644 - protein, 15 aa, Artificial Sequence
  CDR sequence
SSVFSDLRYRKNPKY

SEQ ID NO: 645 - protein, 10 aa, Artificial Sequence
  CDR sequence
VQTTKGNYDY

SEQ ID NO: 646 - protein, 17 aa, Artificial Sequence
  CDR sequence
DLSLSKMVSKITSDMDY

SEQ ID NO: 647 - protein, 13 aa, Artificial Sequence
  CDR sequence
GAWSALRRSVANY

SEQ ID NO: 648 - protein, 17 aa, Artificial Sequence
  CDR sequence
DLSLSKMVSKITSDMDY

SEQ ID NO: 649 - protein, 13 aa, Artificial Sequence
  CDR sequence
GVWSSLRHTAANY

SEQ ID NO: 650 - protein, 19 aa, Artificial Sequence
  CDR sequence
TYLTAQAVGVPVAYYEFDY

SEQ ID NO: 651 - protein, 13 aa, Artificial Sequence
  CDR sequence
GAWSALRRSVANY

SEQ ID NO: 652 - protein, 17 aa, Artificial Sequence
  CDR sequence
LVVSHNYSDYVPFPDDY

SEQ ID NO: 653 - protein, 13 aa, Artificial Sequence
  CDR sequence
IVTYSDYDLGNDY

SEQ ID NO: 654 - protein, 13 aa, Artificial Sequence
  CDR sequence
GVWSSLRHTAANY

SEQ ID NO: 655 - protein, 17 aa, Artificial Sequence
  CDR sequence
IWGIFFNEKMPVGAYDY

SEQ ID NO: 656 - protein, 13 aa, Artificial Sequence
  CDR sequence
GVWSSLRHTAANY

SEQ ID NO: 657 - protein, 17 aa, Artificial Sequence
  CDR sequence
IWGIFFNEKMPVGAYDY

SEQ ID NO: 658 - protein, 13 aa, Artificial Sequence
  CDR sequence
GVWSSLRHTAANY

SEQ ID NO: 659 - protein, 17 aa, Artificial Sequence
  CDR sequence
IWGIFFNEKMPVGAYDY

SEQ ID NO: 660 - protein, 17 aa, Artificial Sequence
  CDR sequence
IWGIFFNEKMPVGAYDY

SEQ ID NO: 661 - protein, 17 aa, Artificial Sequence
  CDR sequence
IWGIFFNEKMPVGAYDY

SEQ ID NO: 662 - protein, 17 aa, Artificial Sequence
  CDR sequence
IWGIFFNEKMPVGAYDY

SEQ ID NO: 663 - protein, 13 aa, Artificial Sequence
  CDR sequence
IVTDSDYDLGNDY

SEQ ID NO: 664 - protein, 19 aa, Artificial Sequence
  CDR sequence
VFTTAQAMGVPNNPYEYDF

SEQ ID NO: 665 - protein, 19 aa, Artificial Sequence
  CDR sequence
VLTTAQAMGVPTRSYEYDY

SEQ ID NO: 666 - protein, 17 aa, Artificial Sequence
  CDR sequence
LVVSHNYSDYVPFPDDY

SEQ ID NO: 667 - protein, 13 aa, Artificial Sequence
  CDR sequence
GVWSSLRHTAANY

SEQ ID NO: 668 - protein, 17 aa, Artificial Sequence
  CDR sequence
IWGIFFNEKMPVGAYDY

SEQ ID NO: 669 - protein, 17 aa, Artificial Sequence
  CDR sequence
IWGIFFNEKMPVGAYDY

SEQ ID NO: 670 - protein, 13 aa, Artificial Sequence
  CDR sequence
GAWSALRRSVANY

SEQ ID NO: 671 - protein, 8 aa, Artificial Sequence
  CDR sequence
YQAGWGDY

SEQ ID NO: 672 - protein, 12 aa, Artificial Sequence
  CDR sequence
RASVPGRGYQDY

SEQ ID NO: 673 - protein, 12 aa, Artificial Sequence
  CDR sequence
RASVPGRGYQDY

SEQ ID NO: 674 - protein, 14 aa, Artificial Sequence
  CDR sequence
DPRRIGANIKYSDY

SEQ ID NO: 675 - protein, 16 aa, Artificial Sequence
  CDR sequence
RGTYLNGDHYSTNYNS

SEQ ID NO: 676 - protein, 13 aa, Artificial Sequence
  CDR sequence
DEGMDYDGNFYDR

SEQ ID NO: 677 - protein, 17 aa, Artificial Sequence
  CDR sequence
DPPPFASDYSAPQSYDY

SEQ ID NO: 678 - protein, 19 aa, Artificial Sequence
  CDR sequence
STKYYSSTYNYIHPAFYDI

SEQ ID NO: 679 - protein, 17 aa, Artificial Sequence
  CDR sequence
DPPPFASDYSAPQSYDY

SEQ ID NO: 680 - protein, 16 aa, Artificial Sequence
  CDR sequence
GIYFSRRYVDPGIYGT

SEQ ID NO: 681 - protein, 11 aa, Artificial Sequence
  CDR sequence
GRYEGGVWRDY

SEQ ID NO: 682 - protein, 13 aa, Artificial Sequence
  CDR sequence
GAWSSLRKTAASY

SEQ ID NO: 683 - protein, 17 aa, Artificial Sequence
  CDR sequence
IWGIFFNEKMPVGAYDY

SEQ ID NO: 684 - protein, 13 aa, Artificial Sequence
  CDR sequence
GVWSSLRHTAANY

SEQ ID NO: 685 - protein, 17 aa, Artificial Sequence
  CDR sequence
DLSLSKMVSKITSDMDY

SEQ ID NO: 686 - protein, 10 aa, Artificial Sequence
  CDR sequence
HIRFPFPNDY

SEQ ID NO: 687 - protein, 17 aa, Artificial Sequence
  CDR sequence
IWGIFFNEKMPVGAYDY

SEQ ID NO: 688 - protein, 17 aa, Artificial Sequence
  CDR sequence
LVVSHNYSDYVPFPDDY

SEQ ID NO: 689 - protein, 17 aa, Artificial Sequence
  CDR sequence
LVVSHNYSDYVPFPDDY

SEQ ID NO: 690 - protein, 13 aa, Artificial Sequence
  CDR sequence
IVTDSDYDLGNDY

SEQ ID NO: 691 - protein, 17 aa, Artificial Sequence
  CDR sequence
IWGIFFNEKMPVGAYDY

SEQ ID NO: 692 - protein, 17 aa, Artificial Sequence
  CDR sequence
IWGIFFNEKMPVGAYDY

SEQ ID NO: 693 - protein, 17 aa, Artificial Sequence
  CDR sequence
LVVSHNYSDYVPFPDDY

SEQ ID NO: 694 - protein, 19 aa, Artificial Sequence
  CDR sequence
DLSLYGCYVGDRDLYDYDY

SEQ ID NO: 695 - protein, 17 aa, Artificial Sequence
  CDR sequence
LVVSHNYSDYVPFPDDY

SEQ ID NO: 696 - protein, 17 aa, Artificial Sequence
  CDR sequence
LVVSHNYSDYVPFPDDY

SEQ ID NO: 697 - protein, 8 aa, Artificial Sequence
  CDR sequence
YQAGWGDY

SEQ ID NO: 698 - protein, 10 aa, Artificial Sequence
  CDR sequence
NVGVTGSYEY

SEQ ID NO: 699 - protein, 14 aa, Artificial Sequence
  CDR sequence
GYMSGAESPIGYDN

SEQ ID NO: 700 - protein, 8 aa, Artificial Sequence
  CDR sequence
YQAGWGDY

SEQ ID NO: 701 - protein, 8 aa, Artificial Sequence
  CDR sequence
YQAGWGDY

SEQ ID NO: 702 - protein, 8 aa, Artificial Sequence
  CDR sequence
YQAGWGDY

SEQ ID NO: 703 - protein, 12 aa, Artificial Sequence
  CDR sequence
SNRYDYADFSAV

SEQ ID NO: 704 - protein, 8 aa, Artificial Sequence
  CDR sequence
YQAGWGDY

SEQ ID NO: 705 - protein, 13 aa, Artificial Sequence
  CDR sequence
GAWSSLRSTAANY

SEQ ID NO: 706 - protein, 18 aa, Artificial Sequence
  CDR sequence
NTYYSGAYFPRGHEWYEY

SEQ ID NO: 707 - protein, 13 aa, Artificial Sequence
  CDR sequence
GAWSSLRSTAANY

SEQ ID NO: 708 - protein, 13 aa, Artificial Sequence
  CDR sequence
GAWSSLRSTAANY

SEQ ID NO: 709 - protein, 18 aa, Artificial Sequence
  CDR sequence
EPPDSSWYLDGSPEFFKY

SEQ ID NO: 710 - protein, 18 aa, Artificial Sequence
  CDR sequence
EPPDSSWYLDGSPEFFKY

SEQ ID NO: 711 - protein, 16 aa, Artificial Sequence
  CDR sequence
RTKDNTLFTPAEEYDY

SEQ ID NO: 712 - protein, 13 aa, Artificial Sequence
  CDR sequence
GAWSSLRSTAANY

SEQ ID NO: 713 - protein, 11 aa, Artificial Sequence
  CDR sequence
GRYEGGVWRDY

SEQ ID NO: 714 - protein, 19 aa, Artificial Sequence
  CDR sequence
STKYYSSTYNYIHPAFYDI

SEQ ID NO: 715 - protein, 19 aa, Artificial Sequence
  CDR sequence
STKYYSSTYNYIHPAFYDI

SEQ ID NO: 716 - protein, 19 aa, Artificial Sequence
  CDR sequence
STKYYSSTYNYIHPAFYDI

SEQ ID NO: 717 - protein, 19 aa, Artificial Sequence
  CDR sequence
STKYYSSTYNYIHPAFYDI

SEQ ID NO: 718 - protein, 19 aa, Artificial Sequence
  CDR sequence
STKYYSSTYNYIHPAFYDI

SEQ ID NO: 719 - protein, 19 aa, Artificial Sequence
  CDR sequence
STKYYSSTYNYIHPAFYDI

SEQ ID NO: 720 - protein, 19 aa, Artificial Sequence
  CDR sequence
STKYYSSTYNYIHPAFYDI

SEQ ID NO: 721 - protein, 14 aa, Artificial Sequence
  CDR sequence
TMVPRAMVVDEFEY

SEQ ID NO: 722 - protein, 19 aa, Artificial Sequence
  CDR sequence
STKYYSSTYNYIHPAFYDI

SEQ ID NO: 723 - protein, 9 aa, Artificial Sequence
  CDR sequence
AHGSSTYNY

SEQ ID NO: 724 - protein, 10 aa, Artificial Sequence
  CDR sequence
DIRGRENFGS

SEQ ID NO: 725 - protein, 11 aa, Artificial Sequence
  CDR sequence
YYRYGSSVPQY

SEQ ID NO: 726 - protein, 8 aa, Artificial Sequence
  CDR sequence
PTENQPDH

SEQ ID NO: 727 - protein, 11 aa, Artificial Sequence
  Framework sequence
WGQGTQVTVSS

SEQ ID NO: 728 - protein, 11 aa, Artificial Sequence
  Framework sequence
WGQGTQVTVSS

SEQ ID NO: 729 - protein, 11 aa, Artificial Sequence
  Framework sequence
WGQGTQVTVSS

SEQ ID NO: 730 - protein, 11 aa, Artificial Sequence
  Framework sequence
WGQGTQVTVSS

SEQ ID NO: 731 - protein, 11 aa, Artificial Sequence
  Framework sequence
WGKGTLVTVSS

SEQ ID NO: 732 - protein, 11 aa, Artificial Sequence
  Framework sequence
WGQGTQVTVSS

SEQ ID NO: 733 - protein, 11 aa, Artificial Sequence
  Framework sequence
WGKGTLVTVSS

SEQ ID NO: 734 - protein, 11 aa, Artificial Sequence
  Framework sequence
WGQGTQVTVSS

SEQ ID NO: 735 - protein, 11 aa, Artificial Sequence
  Framework sequence
WGQGTQVTVSS

SEQ ID NO: 736 - protein, 11 aa, Artificial Sequence
  Framework sequence
WGQGTQVTVSS

SEQ ID NO: 737 - protein, 11 aa, Artificial Sequence
  Framework sequence
WGQGTQVTVSS

SEQ ID NO: 738 - protein, 11 aa, Artificial Sequence
  Framework sequence
WGQGTQVTVSS

SEQ ID NO: 739 - protein, 11 aa, Artificial Sequence
  Framework sequence
WGQGTQVTVSS

SEQ ID NO: 740 - protein, 11 aa, Artificial Sequence
  Framework sequence
WGQGTQVTVSS

SEQ ID NO: 741 - protein, 11 aa, Artificial Sequence
  Framework sequence
WGQGTQVTVSS

SEQ ID NO: 742 - protein, 11 aa, Artificial Sequence
  Framework sequence
WGQGTQVTVSS

SEQ ID NO: 743 - protein, 11 aa, Artificial Sequence
  Framework sequence
WGQGTQVTVSS

SEQ ID NO: 744 - protein, 11 aa, Artificial Sequence
  Framework sequence
WGQGTQVTVSS

SEQ ID NO: 745 - protein, 11 aa, Artificial Sequence
  Framework sequence
WGQGTQVTVSS

SEQ ID NO: 746 - protein, 11 aa, Artificial Sequence
  Framework sequence
WGQGTQVTVSS

SEQ ID NO: 747 - protein, 11 aa, Artificial Sequence
  Framework sequence
WGQGTQVTVSS

SEQ ID NO: 748 - protein, 11 aa, Artificial Sequence
  Framework sequence
WGQGTQVTVSS

SEQ ID NO: 749 - protein, 11 aa, Artificial Sequence
  Framework sequence
WGQGTQVTVSS

SEQ ID NO: 750 - protein, 11 aa, Artificial Sequence
  Framework sequence
WGQGTQVTVSS

SEQ ID NO: 751 - protein, 11 aa, Artificial Sequence
  Framework sequence
WGQGTQVTVSS

SEQ ID NO: 752 - protein, 11 aa, Artificial Sequence
  Framework sequence
WGQGTQVTVSS

SEQ ID NO: 753 - protein, 11 aa, Artificial Sequence
  Framework sequence
WGQGTQVTVSS

SEQ ID NO: 754 - protein, 11 aa, Artificial Sequence
  Framework sequence
WGQGTQVTVSS

SEQ ID NO: 755 - protein, 11 aa, Artificial Sequence
  Framework sequence
WGQGTQVTVSS

SEQ ID NO: 756 - protein, 11 aa, Artificial Sequence
  Framework sequence
WGQGTQVTVSS

SEQ ID NO: 757 - protein, 11 aa, Artificial Sequence
  Framework sequence
WGQGTQVTVSS

SEQ ID NO: 758 - protein, 11 aa, Artificial Sequence
  Framework sequence
WGQGTQVTVSS

SEQ ID NO: 759 - protein, 11 aa, Artificial Sequence
  Framework sequence
WGQGTQVTVSS

SEQ ID NO: 760 - protein, 11 aa, Artificial Sequence
  Framework sequence
WGQGTQVTVSS

SEQ ID NO: 761 - protein, 11 aa, Artificial Sequence
  Framework sequence
WGQGTQVTVSS

SEQ ID NO: 762 - protein, 11 aa, Artificial Sequence
  Framework sequence
WGQGTQVTVSS

SEQ ID NO: 763 - protein, 11 aa, Artificial Sequence
  Framework sequence
WGQGTQVTVSS

SEQ ID NO: 764 - protein, 11 aa, Artificial Sequence
  Framework sequence
WGQGTQVTVSS

SEQ ID NO: 765 - protein, 11 aa, Artificial Sequence
  Framework sequence
WGQGTQVTVSS

SEQ ID NO: 766 - protein, 11 aa, Artificial Sequence
  Framework sequence
WGQGTQVTVSS

SEQ ID NO: 767 - protein, 11 aa, Artificial Sequence
  Framework sequence
WGQGTQVTVSS

SEQ ID NO: 768 - protein, 11 aa, Artificial Sequence
  Framework sequence
WGQGTQVTVSS

SEQ ID NO: 769 - protein, 11 aa, Artificial Sequence
  Framework sequence
WGQGTQVTVSS

SEQ ID NO: 770 - protein, 11 aa, Artificial Sequence
  Framework sequence
WGKGTLVTVSS

SEQ ID NO: 771 - protein, 11 aa, Artificial Sequence
  Framework sequence
WGQGTQVTVSS

SEQ ID NO: 772 - protein, 11 aa, Artificial Sequence
  Framework sequence
WGQGTQVTVSS

SEQ ID NO: 773 - protein, 11 aa, Artificial Sequence
  Framework sequence
WGQGTQVTVSS

SEQ ID NO: 774 - protein, 11 aa, Artificial Sequence
  Framework sequence
WGQGTQVTVSS

SEQ ID NO: 775 - protein, 11 aa, Artificial Sequence
  Framework sequence
WGQGTQVTVSS

SEQ ID NO: 776 - protein, 11 aa, Artificial Sequence
  Framework sequence
WGQGTQVTVSS

SEQ ID NO: 777 - protein, 11 aa, Artificial Sequence
  Framework sequence
WGQGTQVTVSS

SEQ ID NO: 778 - protein, 11 aa, Artificial Sequence
  Framework sequence
WGQGTQVTVSS

SEQ ID NO: 779 - protein, 11 aa, Artificial Sequence
  Framework sequence
WGQGTQVTVSS

SEQ ID NO: 780 - protein, 11 aa, Artificial Sequence
  Framework sequence
WGQGTQVTVSS

SEQ ID NO: 781 - protein, 11 aa, Artificial Sequence
  Framework sequence
WGQGTQVTVSS

SEQ ID NO: 782 - protein, 11 aa, Artificial Sequence
  Framework sequence
WGQGTQVTVSS

SEQ ID NO: 783 - protein, 11 aa, Artificial Sequence
  Framework sequence
WGQGTQVTVSS

SEQ ID NO: 784 - protein, 11 aa, Artificial Sequence
  Framework sequence
WGQGTQVTVSS

SEQ ID NO: 785 - protein, 11 aa, Artificial Sequence
  Framework sequence
WGQGTQVTVSS

SEQ ID NO: 786 - protein, 11 aa, Artificial Sequence
  Framework sequence
WGQGTQVTVSS

SEQ ID NO: 787 - protein, 11 aa, Artificial Sequence
  Framework sequence
WGQGTQVTVSS

SEQ ID NO: 788 - protein, 11 aa, Artificial Sequence
  Framework sequence
RGQGTQVTVSS

SEQ ID NO: 789 - protein, 11 aa, Artificial Sequence
  Framework sequence
WGQGTQVTVSS

SEQ ID NO: 790 - protein, 11 aa, Artificial Sequence
  Framework sequence
WGQGTQVTVSS

SEQ ID NO: 791 - protein, 11 aa, Artificial Sequence
  Framework sequence
WGQGTQVTVSS

SEQ ID NO: 792 - protein, 11 aa, Artificial Sequence
  Framework sequence
WGQGTKVTVSS

SEQ ID NO: 793 - protein, 11 aa, Artificial Sequence
  Framework sequence
WGQGTQVTVSS

SEQ ID NO: 794 - protein, 11 aa, Artificial Sequence
  Framework sequence
WGQGTQVTVSS

SEQ ID NO: 795 - protein, 11 aa, Artificial Sequence
  Framework sequence
WGQGTQVTVSS

SEQ ID NO: 796 - protein, 11 aa, Artificial Sequence
  Framework sequence
WGQGTQVTVSS

SEQ ID NO: 797 - protein, 11 aa, Artificial Sequence
  Framework sequence
WGQGTQVTVSS

SEQ ID NO: 798 - protein, 11 aa, Artificial Sequence
  Framework sequence
WGQGTQVTVSS

SEQ ID NO: 799 - protein, 11 aa, Artificial Sequence
  Framework sequence
WGQGTQVTVSS

SEQ ID NO: 800 - protein, 11 aa, Artificial Sequence
  Framework sequence
WGQGTQVTVSS

SEQ ID NO: 801 - protein, 11 aa, Artificial Sequence
  Framework sequence
WGQGTQVTVSS

SEQ ID NO: 802 - protein, 11 aa, Artificial Sequence
  Framework sequence
WGQGTQVTVSS

SEQ ID NO: 803 - protein, 11 aa, Artificial Sequence
  Framework sequence
WGQGTQVTVSS

SEQ ID NO: 804 - protein, 11 aa, Artificial Sequence
  Framework sequence
WGQGTQVTVSS

SEQ ID NO: 805 - protein, 11 aa, Artificial Sequence
  Framework sequence
WGQGTQVTVSS

SEQ ID NO: 806 - protein, 11 aa, Artificial Sequence
  Framework sequence
WGQGTQVTVSS

SEQ ID NO: 807 - protein, 11 aa, Artificial Sequence
  Framework sequence
WGQGTQVTVSS

SEQ ID NO: 808 - protein, 11 aa, Artificial Sequence
  Framework sequence
WGQGTQVTVSS

SEQ ID NO: 809 - protein, 11 aa, Artificial Sequence
  Framework sequence
WGQGTQVTVSS

SEQ ID NO: 810 - protein, 11 aa, Artificial Sequence
  Framework sequence
WGQGTQVTVSS

SEQ ID NO: 811 - protein, 11 aa, Artificial Sequence
  Framework sequence
WGQGTQVTVSS

SEQ ID NO: 812 - protein, 259 aa, Artificial Sequence
  Nanobody
EVQLVESGGGLVQAGGSLSLSCATSGRTISDDTMAWFRQAPGKEREFVAIITFNGARTHYSDSVRDRFTISRDNAKNTVYLQMNSLKSEDTAVYYCAASTKYYSSTYNYIHPAFYDIWGQGTQVTVSSGGGGSGGGSEVQLVESGGGLVQAGGSLRLSCTASGRTFTDYDMGWFRQAPGKEREVVAIIDTNGDNTLTVGSVKGRFAISSDNAKNTVYLQMNSLLPEDTAVYTCAAGAWSALRRSVANYWGQGTQVTVSS

SEQ ID NO: 813 - protein, 260 aa, Artificial Sequence
  Nanobody
EVQLVESGGGLVQAGGSLSLSCATSGRTISDDTMAWFRQAPGKEREFVAIITFNGARTHYSDSVRDRFTISRDNAKNTVYLQMNSLKSEDTAVYYCAASTKYYSSTYNYIHPAFYDIWGQGTQVTVSSGGGGSGGGSEVQLVESGGGTVQAGGSLKLSCAASGRTFTNYAMGWFRQAPGKEREFVAAIAYATHFADSVKGRFTISRGNAKNTVYLQMNSLKPEDTAVYYCAADLSLSKMVSKITSDMDYWGKGTLVTVSS

SEQ ID NO: 814 - protein, 257 aa, Artificial Sequence
  Nanobody
EVQLVESGGGLVQAGGSLSLSCATSGRTISDDTMAWFRQAPGKEREFVAIITFNGARTHYSDSVRDRFTISRDNAKNTVYLQMNSLKSEDTAVYYCAASTKYYSSTYNYIHPAFYDIWGQGTQVTVSSGGGGSGGGSEVQLVESGGGLVQPGGSLRLSCAASGSIFSINTMGWYRQVPGKQRELVATVRSGSITNYADSVQDRFTITRDIDENTVYLQMNSLKPEDTAVYYCLTRASVPGRGYQDYWGQGTQVTVSS

SEQ ID NO: 815 - protein, 250 aa, Artificial Sequence
  Nanobody
EVQLVESGGDLVQTGGSLRLSCAASGITVSDRAMGWYRQAPGKQREMVAGVSRGGMTSYADSVKGRLTISRDNAKNSVYLQMNSLNPEDTAVYYCSAYYRYGSSVPQYWGQGTQVTVSSGGGGSGGGSEVQLVESGGGLVQAGGSLRLSCTASGRTFTDYDMGWFRQAPGKEREVVAIIDTNGDNTLTVGSVKGRFAISSDNAKNTVYLQMNSLLPEDTAVYTCAAGAWSALRRSVANYWGQGTQVTVSS

SEQ ID NO: 816 - protein, 251 aa, Artificial Sequence
  Nanobody
EVQLVESGGDLVQTGGSLRLSCAASGITVSDRAMGWYRQAPGKQREMVAGVSRGGMTSYADSVKGRLTISRDNAKNSVYLQMNSLNPEDTAVYYCSAYYRYGSSVPQYWGQGTQVTVSSGGGGSGGGSEVQLVESGGGTVQAGGSLKLSCAASGRTFTNYAMGWFRQAPGKEREFVAAIAYATHFADSVKGRFTISRGNAKNTVYLQMNSLKPEDTAVYYCAADLSLSKMVSKITSDMDYWGKGTLVTVSS

SEQ ID NO: 817 - protein, 248 aa, Artificial Sequence
  Nanobody
EVQLVESGGDLVQTGGSLRLSCAASGITVSDRAMGWYRQAPGKQREMVAGVSRGGMTSYADSVKGRLTISRDNAKNSVYLQMNSLNPEDTAVYYCSAYYRYGSSVPQYWGQGTQVTVSSGGGGSGGGSEVQLVESGGGLVQPGGSLRLSCAASGSIFSINTMGWYRQVPGKQRELVATVRSGSITNYADSVQDRFTITRDIDENTVYLQMNSLKPEDTAVYYCLTRASVPGRGYQDYWGQGTQVTVSS

SEQ ID NO: 818 - protein, 252 aa, Artificial Sequence
  Nanobody
EVQLVESGGGLVQAGGSLRLSCAASGSIFSIKAMGWYRQAPGKQRELVARITSGGSTYYADSVKGRFTISRDNAKNTVYLQMNSLKPEDTAVFYCNAIVTDSDYDLGNDYWGQGTQVTVSSGGGGSGGGSEVQLVESGGGLVQAGGSLRLSCTASGRTFTDYDMGWFRQAPGKEREVVAIIDTNGDNTLTVGSVKGRFAISSDNAKNTVYLQMNSLLPEDTAVYTCAAGAWSALRRSVANYWGQGTQVTVSS

SEQ ID NO: 819 - protein, 253 aa, Artificial Sequence
  Nanobody
EVQLVESGGGLVQAGGSLRLSCAASGSIFSIKAMGWYRQAPGKQRELVARITSGGSTYYADSVKGRFTISRDNAKNTVYLQMNSLKPEDTAVFYCNAIVTDSDYDLGNDYWGQGTQVTVSSGGGGSGGGSEVQLVESGGGTVQAGGSLKLSCAASGRTFTNYAMGWFRQAPGKEREFVAAIAYATHFADSVKGRFTISRGNAKNTVYLQMNSLKPEDTAVYYCAADLSLSKMVSKITSDMDYWGKGTLVTVSS

SEQ ID NO: 820 - protein, 250 aa, Artificial Sequence
  Nanobody
EVQLVESGGGLVQAGGSLRLSCAASGSIFSIKAMGWYRQAPGKQRELVARITSGGSTYYADSVKGRFTISRDNAKNTVYLQMNSLKPEDTAVFYCNAIVTDSDYDLGNDYWGQGTQVTVSSGGGGSGGGSEVQLVESGGGLVQPGGSLRLSCAASGSIFSINTMGWYRQVPGKQRELVATVRSGSITNYADSVQDRFTITRDIDENTVYLQMNSLKPEDTAVYYCLTRASVPGRGYQDYWGQGTQVTVSS

SEQ ID NO: 821 - protein, 257 aa, Artificial Sequence
  Nanobody
EVQLVESGGGLVEAGGSLRLSCAAAGRTLSSYSMAWFRQAPGKEREFVAIIRGNPSRTYHSDSVKGRFTASRDNAKNTVYLQMNRLEPEDTAVYYCAADPPPFASDYSAPQSYDYWGQGTQVTVSSGGGGSGGGSEVQLVESGGGLVQAGGSLRLSCTASGRTFTDYDMGWFRQAPGKEREVVAIIDTNGDNTLTVGSVKGRFAISSDNAKNTVYLQMNSLLPEDTAVYTCAAGAWSALRRSVANYWGQGTQVTVSS

SEQ ID NO: 822 - protein, 258 aa, Artificial Sequence
  Nanobody
EVQLVESGGGLVEAGGSLRLSCAAAGRTLSSYSMAWFRQAPGKEREFVAIIRGNPSRTYHSDSVKGRFTASRDNAKNTVYLQMNRLEPEDTAVYYCAADPPPFASDYSAPQSYDYWGQGTQVTVSSGGGGSGGGSEVQLVESGGGTVQAGGSLKLSCAASGRTFTNYAMGWFRQAPGKEREFVAAIAYATHFADSVKGRFTISRGNAKNTVYLQMNSLKPEDTAVYYCAADLSLSKMVSKITSDMDYWGKGTLVTVSS

SEQ ID NO: 823 - protein, 250 aa, Artificial Sequence
  Nanobody
EVQLVESGGGLVQPGGSLRLSCAASKSIFDINAMYWHRQAPGKQRESVASITSGGMRNYADSVKDRFTISKDNAKNTVYLQMNGLKPDDTAVYYCGLGRYEGGVWRDYWGQGTQVTVSSGGGGSGGGSEVQLVESGGGLVQAGGSLRLSCTASGRTFTDYDMGWFRQAPGKEREVVAIIDTNGDNTLTVGSVKGRFAISSDNAKNTVYLQMNSLLPEDTAVYTCAAGAWSALRRSVANYWGQGTQVTVSS

SEQ ID NO: 824 - protein, 251 aa, Artificial Sequence
  Nanobody
EVQLVESGGGLVQPGGSLRLSCAASKSIFDINAMYWHRQAPGKQRESVASITSGGMRNYADSVKDRFTISKDNAKNTVYLQMNGLKPDDTAVYYCGLGRYEGGVWRDYWGQGTQVTVSSGGGGSGGGSEVQLVESGGGTVQAGGSLKLSCAASGRTFTNYAMGWFRQAPGKEREFVAAIAYATHFADSVKGRFTISRGNAKNTVYLQMNSLKPEDTAVYYCAADLSLSKMVSKITSDMDYWGKGTLVTVSS

SEQ ID NO: 825 - protein, 248 aa, Artificial Sequence
  Nanobody
EVQLVESGGGLVQPGGSLRLSCAASKSIFDINAMYWHRQAPGKQRESVASITSGGMRNYADSVKDRFTISKDNAKNTVYLQMNGLKPDDTAVYYCGLGRYEGGVWRDYWGQGTQVTVSSGGGGSGGGSEVQLVESGGGLVQPGGSLRLSCAASGSIFSINTMGWYRQVPGKQRELVATVRSGSITNYADSVQDRFTITRDIDENTVYLQMNSLKPEDTAVYYCLTRASVPGRGYQDYWGQGTQVTVSS

SEQ ID NO: 826 - protein, 247 aa, Artificial Sequence
  Nanobody
EVQLVESGGGLVQAGGSLNLSCNASGDIGSINAMGWYRQAPGQQREWVAVITDTDSTIYPDSVKGRFAISRDGAKNTVHLRMSSLKPEDTAVYYCNAYQAGWGDYWGQGTQVTVSSGGGGSGGGSEVQLVESGGGLVQAGGSLRLSCTASGRTFTDYDMGWFRQAPGKEREVVAIIDTNGDNTLTVGSVKGRFAISSDNAKNTVYLQMNSLLPEDTAVYTCAAGAWSALRRSVANYWGQGTQVTVSS

SEQ ID NO: 827 - protein, 248 aa, Artificial Sequence
  Nanobody
EVQLVESGGGLVQAGGSLNLSCNASGDIGSINAMGWYRQAPGQQREWVAVITDTDSTIYPDSVKGRFAISRDGAKNTVHLRMSSLKPEDTAVYYCNAYQAGWGDYWGQGTQVTVSSGGGGSGGGSEVQLVESGGGTVQAGGSLKLSCAASGRTFTNYAMGWFRQAPGKEREFVAAIAYATHFADSVKGRFTISRGNAKNTVYLQMNSLKPEDTAVYYCAADLSLSKMVSKITSDMDYWGKGTLVTVSS

SEQ ID NO: 828 - protein, 245 aa, Artificial Sequence
  Nanobody
EVQLVESGGGLVQAGGSLNLSCNASGDIGSINAMGWYRQAPGQQREWVAVITDTDSTIYPDSVKGRFAISRDGAKNTVHLRMSSLKPEDTAVYYCNAYQAGWGDYWGQGTQVTVSSGGGGSGGGSEVQLVESGGGLVQPGGSLRLSCAASGSIFSINTMGWYRQVPGKQRELVATVRSGSITNYADSVQDRFTITRDIDENTVYLQMNSLKPEDTAVYYCLTRASVPGRGYQDYWGQGTQVTVSS

SEQ ID NO: 829 - protein, 249 aa, Artificial Sequence
  Nanobody
EVQLVESGGGLVQAGGSLRLSCAASGGIFSDMFMGWFRQAPGKSRESVARISPSGNTFYQDSVRGRFTISTDNAKNTVYLQMNNLKPEDTAVYYCAANVGVTGSYEYWGQGTQVTVSSGGGGSGGGSEVQLVESGGGLVQAGGSLRLSCTASGRTFTDYDMGWFRQAPGKEREVVAIIDTNGDNTLTVGSVKGRFAISSDNAKNTVYLQMNSLLPEDTAVYTCAAGAWSALRRSVANYWGQGTQVTVSS

SEQ ID NO: 830 - protein, 250 aa, Artificial Sequence
  Nanobody
EVQLVESGGGLVQAGGSLRLSCAASGGIFSDMFMGWFRQAPGKSRESVARISPSGNTFYQDSVRGRFTISTDNAKNTVYLQMNNLKPEDTAVYYCAANVGVTGSYEYWGQGTQVTVSSGGGGSGGGSEVQLVESGGGTVQAGGSLKLSCAASGRTFTNYAMGWFRQAPGKEREFVAAIAYATHFADSVKGRFTISRGNAKNTVYLQMNSLKPEDTAVYYCAADLSLSKMVSKITSDMDYWGKGTLVTVSS

SEQ ID NO: 831 - protein, 247 aa, Artificial Sequence
  Nanobody
EVQLVESGGGLVQAGGSLRLSCAASGGIFSDMFMGWFRQAPGKSRESVARISPSGNTFYQDSVRGRFTISTDNAKNTVYLQMNNLKPEDTAVYYCAANVGVTGSYEYWGQGTQVTVSSGGGGSGGGSEVQLVESGGGLVQPGGSLRLSCAASGSIFSINTMGWYRQVPGKQRELVATVRSGSITNYADSVQDRFTITRDIDENTVYLQMNSLKPEDTAVYYCLTRASVPGRGYQDYWGQGTQVTVSS

SEQ ID NO: 832 - protein, 259 aa, Artificial Sequence; identical to SEQ ID NO: 812
  Nanobody

SEQ ID NO: 833 - protein, 286 aa, Artificial Sequence
  Nanobody
EVQLVESGGGLVQAGGSLSLSCATSGRTISDDTMAWFRQAPGKEREFVAIITFNGARTHYSDSVRDRFTISRDNAKNTVYLQMNSLKSEDTAVYYCAASTKYYSSTYNYIHPAFYDIWGQGTQVTVSSGGGGSGGGGSGGGGSGGGGSGGGGSGGGGSGGGGSEVQLVESGGGTVQAGGSLKLSCAASGRTFTNYAMGWFRQAPGKEREFVAAIAYATHFADSVKGRFTISRGNAKNTVYLQMNSLKPEDTAVYYCAADLSLSKMVSKITSDMDYWGKGTLVTVSS

SEQ ID NO: 834 - protein, 283 aa, Artificial Sequence
  Nanobody
EVQLVESGGGLVQAGGSLSLSCATSGRTISDDTMAWFRQAPGKEREFVAIITFNGARTHYSDSVRDRFTISRDNAKNTVYLQMNSLKSEDTAVYYCAASTKYYSSTYNYIHPAFYDIWGQGTQVTVSSGGGGSGGGGSGGGGSGGGGSGGGGSGGGGSGGGGSEVQLVESGGGLVQPGGSLRLSCAASGSIFSINTMGWYRQVPGKQRELVATVRSGSITNYADSVQDRFTITRDIDENTVYLQMNSLKPEDTAVYYCLTRASVPGRGYQDYWGQGTQVTVSS

SEQ ID NO: 835 - protein, 276 aa, Artificial Sequence
  Nanobody
EVQLVESGGDLVQTGGSLRLSCAASGITVSDRAMGWYRQAPGKQREMVAGVSRGGMTSYADSVKGRLTISRDNAKNSVYLQMNSLNPEDTAVYYCSAYYRYGSSVPQYWGQGTQVTVSSGGGGSGGGGSGGGGSGGGGSGGGGSGGGGSGGGGSEVQLVESGGGLVQAGGSLRLSCTASGRTFTDYDMGWFRQAPGKEREVVAIIDTNGDNTLTVGSVKGRFAISSDNAKNTVYLQMNSLLPEDTAVYTCAAGAWSALRRSVANYWGQGTQVTVSS

SEQ ID NO: 836 - protein, 277 aa, Artificial Sequence
  Nanobody
EVQLVESGGDLVQTGGSLRLSCAASGITVSDRAMGWYRQAPGKQREMVAGVSRGGMTSYADSVKGRLTISRDNAKNSVYLQMNSLNPEDTAVYYCSAYYRYGSSVPQYWGQGTQVTVSSGGGGSGGGGSGGGGSGGGGSGGGGSGGGGSGGGGSEVQLVESGGGTVQAGGSLKLSCAASGRTFTNYAMGWFRQAPGKEREFVAAIAYATHFADSVKGRFTISRGNAKNTVYLQMNSLKPEDTAVYYCAADLSLSKMVSKITSDMDYWGKGTLVTVSS

SEQ ID NO: 837 - protein, 274 aa, Artificial Sequence
  Nanobody
EVQLVESGGDLVQTGGSLRLSCAASGITVSDRAMGWYRQAPGKQREMVAGVSRGGMTSYADSVKGRLTISRDNAKNSVYLQMNSLNPEDTAVYYCSAYYRYGSSVPQYWGQGTQVTVSSGGGGSGGGGSGGGGSGGGGSGGGGSGGGGSGGGGSEVQLVESGGGLVQPGGSLRLSCAASGSIFSINTMGWYRQVPGKQRELVATVRSGSITNYADSVQDRFTITRDIDENTVYLQMNSLKPEDTAVYYCLTRASVPGRGYQDYWGQGTQVTVSS

SEQ ID NO: 838 - protein, 278 aa, Artificial Sequence
  Nanobody
EVQLVESGGGLVQAGGSLRLSCAASGSIFSIKAMGWYRQAPGKQRELVARITSGGSTYYADSVKGRFTISRDNAKNTVYLQMNSLKPEDTAVFYCNAIVTDSDYDLGNDYWGQGTQVTVSSGGGGSGGGGSGGGGSGGGGSGGGGSGGGGSGGGGSEVQLVESGGGLVQAGGSLRLSCTASGRTFTDYDMGWFRQAPGKEREVVAIIDTNGDNTLTVGSVKGRFAISSDNAKNTVYLQMNSLLPEDTAVYTCAAGAWSALRRSVANYWGQGTQVTVSS

SEQ ID NO: 839 - protein, 279 aa, Artificial Sequence
  Nanobody
EVQLVESGGGLVQAGGSLRLSCAASGSIFSIKAMGWYRQAPGKQRELVARITSGGSTYYADSVKGRFTISRDNAKNTVYLQMNSLKPEDTAVFYCNAIVTDSDYDLGNDYWGQGTQVTVSSGGGGSGGGGSGGGGSGGGGSGGGGSGGGGSGGGGSEVQLVESGGGTVQAGGSLKLSCAASGRTFTNYAMGWFRQAPGKEREFVAAIAYATHFADSVKGRFTISRGNAKNTVYLQMNSLKPEDTAVYYCAADLSLSKMVSKITSDMDYWGKGTLVTVSS

SEQ ID NO: 840 - protein, 276 aa, Artificial Sequence
  Nanobody
EVQLVESGGGLVQAGGSLRLSCAASGSIFSIKAMGWYRQAPGKQRELVARITSGGSTYYADSVKGRFTISRDNAKNTVYLQMNSLKPEDTAVFYCNAIVTDSDYDLGNDYWGQGTQVTVSSGGGGSGGGGSGGGGSGGGGSGGGGSGGGGSGGGGSEVQLVESGGGLVQPGGSLRLSCAASGSIFSINTMGWYRQVPGKQRELVATVRSGSITNYADSVQDRFTITRDIDENTVYLQMNSLKPEDTAVYYCLTRASVPGRGYQDYWGQGTQVTVSS

SEQ ID NO: 841 - protein, 283 aa, Artificial Sequence
  Nanobody
EVQLVESGGGLVEAGGSLRLSCAAAGRTLSSYSMAWFRQAPGKEREFVAIIRGNPSRTYHSDSVKGRFTASRDNAKNTVYLQMNRLEPEDTAVYYCAADPPPFASDYSAPQSYDYWGQGTQVTVSSGGGGSGGGGSGGGGSGGGGSGGGGSGGGGSGGGGSEVQLVESGGGLVQAGGSLRLSCTASGRTFTDYDMGWFRQAPGKEREVVAIIDTNGDNTLTVGSVKGRFAISSDNAKNTVYLQMNSLLPEDTAVYTCAAGAWSALRRSVANYWGQGTQVTVSS

SEQ ID NO: 842 - protein, 284 aa, Artificial Sequence
  Nanobody
EVQLVESGGGLVEAGGSLRLSCAAAGRTLSSYSMAWFRQAPGKEREFVAIIRGNPSRTYHSDSVKGRFTASRDNAKNTVYLQMNRLEPEDTAVYYCAADPPPFASDYSAPQSYDYWGQGTQVTVSSGGGGSGGGGSGGGGSGGGGSGGGGSGGGGSGGGGSEVQLVESGGGTVQAGGSLKLSCAASGRTFTNYAMGWFRQAPGKEREFVAAIAYATHFADSVKGRFTISRGNAKNTVYLQMNSLKPEDTAVYYCAADLSLSKMVSKITSDMDYWGKGTLVTVSS

SEQ ID NO: 843 - protein, 276 aa, Artificial Sequence
  Nanobody
EVQLVESGGGLVQPGGSLRLSCAASKSIFDINAMYWHRQAPGKQRESVASITSGGMRNYADSVKDRFTISKDNAKNTVYLQMNGLKPDDTAVYYCGLGRYEGGVWRDYWGQGTQVTVSSGGGGSGGGGSGGGGSGGGGSGGGGSGGGGSGGGGSEVQLVESGGGLVQAGGSLRLSCTASGRTFTDYDMGWFRQAPGKEREVVAIIDTNGDNTLTVGSVKGRFAISSDNAKNTVYLQMNSLLPEDTAVYTCAAGAWSALRRSVANYWGQGTQVTVSS

SEQ ID NO: 844 - protein, 277 aa, Artificial Sequence
  Nanobody
EVQLVESGGGLVQPGGSLRLSCAASKSIFDINAMYWHRQAPGKQRESVASITSGGMRNYADSVKDRFTISKDNAKNTVYLQMNGLKPDDTAVYYCGLGRYEGGVWRDYWGQGTQVTVSSGGGGSGGGGSGGGGSGGGGSGGGGSGGGGSGGGGSEVQLVESGGGTVQAGGSLKLSCAASGRTFTNYAMGWFRQAPGKEREFVAAIAYATHFADSVKGRFTISRGNAKNTVYLQMNSLKPEDTAVYYCAADLSLSKMVSKITSDMDYWGKGTLVTVSS

SEQ ID NO: 845 - protein, 274 aa, Artificial Sequence
  Nanobody
EVQLVESGGGLVQPGGSLRLSCAASKSIFDINAMYWHRQAPGKQRESVASITSGGMRNYADSVKDRFTISKDNAKNTVYLQMNGLKPDDTAVYYCGLGRYEGGVWRDYWGQGTQVTVSSGGGGSGGGGSGGGGSGGGGSGGGGSGGGGSGGGGSEVQLVESGGGLVQPGGSLRLSCAASGSIFSINTMGWYRQVPGKQRELVATVRSGSITNYADSVQDRFTITRDIDENTVYLQMNSLKPEDTAVYYCLTRASVPGRGYQDYWGQGTQVTVSS

SEQ ID NO: 846 - protein, 273 aa, Artificial Sequence
  Nanobody
EVQLVESGGGLVQAGGSLNLSCNASGDIGSINAMGWYRQAPGQQREWVAVITDTDSTIYPDSVKGRFAISRDGAKNTVHLRMSSLKPEDTAVYYCNAYQAGWGDYWGQGTQVTVSSGGGGSGGGGSGGGGSGGGGSGGGGSGGGGSGGGGSEVQLVESGGGLVQAGGSLRLSCTASGRTFTDYDMGWFRQAPGKEREVVAIIDTNGDNTLTVGSVKGRFAISSDNAKNTVYLQMNSLLPEDTAVYTCAAGAWSALRRSVANYWGQGTQVTVSS

SEQ ID NO: 847 - protein, 274 aa, Artificial Sequence
  Nanobody
EVQLVESGGGLVQAGGSLNLSCNASGDIGSINAMGWYRQAPGQQREWVAVITDTDSTIYPDSVKGRFAISRDGAKNTVHLRMSSLKPEDTAVYYCNAYQAGWGDYWGQGTQVTVSSGGGGSGGGGSGGGGSGGGGSGGGGSGGGGSGGGGSEVQLVESGGGTVQAGGSLKLSCAASGRTFTNYAMGWFRQAPGKEREFVAAIAYATHFADSVKGRFTISRGNAKNTVYLQMNSLKPEDTAVYYCAADLSLSKMVSKITSDMDYWGKGTLVTVSS

SEQ ID NO: 848 - protein, 271 aa, Artificial Sequence
  Nanobody
EVQLVESGGGLVQAGGSLNLSCNASGDIGSINAMGWYRQAPGQQREWVAVITDTDSTIYPDSVKGRFAISRDGAKNTVHLRMSSLKPEDTAVYYCNAYQAGWGDYWGQGTQVTVSSGGGGSGGGGSGGGGSGGGGSGGGGSGGGGSGGGGSEVQLVESGGGLVQPGGSLRLSCAASGSIFSINTMGWYRQVPGKQRELVATVRSGSITNYADSVQDRFTITRDIDENTVYLQMNSLKPEDTAVYYCLTRASVPGRGYQDYWGQGTQVTVSS

SEQ ID NO: 849 - protein, 275 aa, Artificial Sequence
  Nanobody
EVQLVESGGGLVQAGGSLRLSCAASGGIFSDMFMGWFRQAPGKSRESVARISPSGNTFYQDSVRGRFTISTDNAKNTVYLQMNNLKPEDTAVYYCAANVGVTGSYEYWGQGTQVTVSSGGGGSGGGGSGGGGSGGGGSGGGGSGGGGSGGGGSEVQLVESGGGLVQAGGSLRLSCTASGRTFTDYDMGWFRQAPGKEREVVAIIDTNGDNTLTVGSVKGRFAISSDNAKNTVYLQMNSLLPEDTAVYTCAAGAWSALRRSVANYWGQGTQVTVSS

SEQ ID NO: 850 - protein, 276 aa, Artificial Sequence
  Nanobody
EVQLVESGGGLVQAGGSLRLSCAASGGIFSDMFMGWFRQAPGKSRESVARISPSGNTFYQDSVRGRFTISTDNAKNTVYLQMNNLKPEDTAVYYCAANVGVTGSYEYWGQGTQVTVSSGGGGSGGGGSGGGGSGGGGSGGGGSGGGGSGGGGSEVQLVESGGGTVQAGGSLKLSCAASGRTFTNYAMGWFRQAPGKEREFVAAIAYATHFADSVKGRFTISRGNAKNTVYLQMNSLKPEDTAVYYCAADLSLSKMVSKITSDMDYWGKGTLVTVSS

SEQ ID NO: 851 - protein, 273 aa, Artificial Sequence
  Nanobody
EVQLVESGGGLVQAGGSLRLSCAASGGIFSDMFMGWFRQAPGKSRESVARISPSGNTFYQDSVRGRFTISTDNAKNTVYLQMNNLKPEDTAVYYCAANVGVTGSYEYWGQGTQVTVSSGGGGSGGGGSGGGGSGGGGSGGGGSGGGGSGGGGSEVQLVESGGGLVQPGGSLRLSCAASGSIFSINTMGWYRQVPGKQRELVATVRSGSITNYADSVQDRFTITRDIDENTVYLQMNSLKPEDTAVYYCLTRASVPGRGYQDYWGQGTQVTVSS

SEQ ID NO: 852 - protein, 260 aa, Artificial Sequence
  Nanobody
EVQLVESGGGLVQAGGSLSLSCATSGRTISDDTMAWFRQAPGKEREFVAIITFNGARTHYSDSVRDRFTISRDNAKNTVYLQMNSLKSEDTAVYYCAASTKYYSSTYNYIHPAFYDIWGQGTQVTVSSGGGGSGGGSEVQLVESGGGLVQAGDSLRLSCLASGRSFKDDAMGWFRQAPGKEREFVSGIDWRGNIVDAESVKGRFTISRENAKNTLYLQMNHLKPEDTAVYYCAASSVFSDLRYRKNPKYWGQGTQVTVSS

SEQ ID NO: 853 - protein, 265 aa, Artificial Sequence
  Nanobody
EVQLVESGGGLVQAGGSLSLSCATSGRTISDDTMAWFRQAPGKEREFVAIITFNGARTHYSDSVRDRFTISRDNAKNTVYLQMNSLKSEDTAVYYCAASTKYYSSTYNYIHPAFYDIWGQGTQVTVSSGGGGSGGGSEVQLVESGGGLVQPGGSLRLSCAASGVTLDYYAIGWFRQAPGKEREGVSSISSNDGSTFYADSVKGRFTISRDKAKNTVYLQMNSLKPEDTAVYYCAATYLTAQAVGVPVAYYEFDYWGQGTQVTVSS

SEQ ID NO: 854 - protein, 258 aa, Artificial Sequence
  Nanobody
EVQLVESGGGLVQAGGSLSLSCATSGRTISDDTMAWFRQAPGKEREFVAIITFNGARTHYSDSVRDRFTISRDNAKNTVYLQMNSLKSEDTAVYYCAASTKYYSSTYNYIHPAFYDIWGQGTQVTVSSGGGGSGGGSKVQLVESGGGLVQPGGSLRLSCAASGFTFSSYAMSWVRRAPGKGLEWVSAINSDGTGSSYAPFVTGRFTASRDNAKNTLYLQMNSLKPEDTAVYYCTNSNRYDYADFSAVRGQGTQVTVSS

SEQ ID NO: 855 - protein, 260 aa, Artificial Sequence
  Nanobody
EVQLVESGGGLVQAGGSLSLSCATSGRTISDDTMAWFRQAPGKEREFVAIITFNGARTHYSDSVRDRFTISRDNAKNTVYLQMNSLKSEDTAVYYCAASTKYYSSTYNYIHPAFYDIWGQGTQVTVSSGGGGSGGGSEVQLVESGGGLVQAGDSLRLSCVASGLPFSTLHMGWFRQAPGKEHESVSAISSDGGSEYYAGSVKGRFTISRDNAKNTVYLQMNSLKPEDTAVYYCAADPRRIGANIKYSDYWGQGTQVTVSS

SEQ ID NO: 856 - protein, 261 aa, Artificial Sequence
  Nanobody
EVQLVESGGGLVQAGGSLSLSCATSGRTISDDTMAWFRQAPGKEREFVAIITFNGARTHYSDSVRDRFTISRDNAKNTVYLQMNSLKSEDTAVYYCAASTKYYSSTYNYIHPAFYDIWGQGTQVTVSSGGGGSGGGSEVQLVESGGGLVQPGGSLRLSCAASGSTFSINMMAWYCQAPGKQRELVASISSGGGINYADSVKGRFTISRDYAENSVDLQMNSLKPEDTAVYYCNARGTYLNGDHYSTNYNSWGQGTQVTVSS

SEQ ID NO: 857 - protein, 251 aa, Artificial Sequence
  Nanobody
EVQLVESGGDLVQTGGSLRLSCAASGITVSDRAMGWYRQAPGKQREMVAGVSRGGMTSYADSVKGRLTISRDNAKNSVYLQMNSLNPEDTAVYYCSAYYRYGSSVPQYWGQGTQVTVSSGGGGSGGGSEVQLVESGGGLVQAGDSLRLSCLASGRSFKDDAMGWFRQAPGKEREFVSGIDWRGNIVDAESVKGRFTISRENAKNTLYLQMNHLKPEDTAVYYCAASSVFSDLRYRKNPKYWGQGTQVTVSS

SEQ ID NO: 858 - protein, 256 aa, Artificial Sequence
  Nanobody
EVQLVESGGDLVQTGGSLRLSCAASGITVSDRAMGWYRQAPGKQREMVAGVSRGGMTSYADSVKGRLTISRDNAKNSVYLQMNSLNPEDTAVYYCSAYYRYGSSVPQYWGQGTQVTVSSGGGGSGGGSEVQLVESGGGLVQPGGSLRLSCAASGVTLDYYAIGWFRQAPGKEREGVSSISSNDGSTFYADSVKGRFTISRDKAKNTVYLQMNSLKPEDTAVYYCAATYLTAQAVGVPVAYYEFDYWGQGTQVTVSS

SEQ ID NO: 859 - protein, 249 aa, Artificial Sequence
  Nanobody
EVQLVESGGDLVQTGGSLRLSCAASGITVSDRAMGWYRQAPGKQREMVAGVSRGGMTSYADSVKGRLTISRDNAKNSVYLQMNSLNPEDTAVYYCSAYYRYGSSVPQYWGQGTQVTVSSGGGGSGGGSKVQLVESGGGLVQPGGSLRLSCAASGFTFSSYAMSWVRRAPGKGLEWVSAINSDGTGSSYAPFVTGRFTASRDNAKNTLYLQMNSLKPEDTAVYYCTNSNRYDYADFSAVRGQGTQVTVSS

SEQ ID NO: 860 - protein, 251 aa, Artificial Sequence
  Nanobody
EVQLVESGGDLVQTGGSLRLSCAASGITVSDRAMGWYRQAPGKQREMVAGVSRGGMTSYADSVKGRLTISRDNAKNSVYLQMNSLNPEDTAVYYCSAYYRYGSSVPQYWGQGTQVTVSSGGGGSGGGSEVQLVESGGGLVQAGDSLRLSCVASGLPFSTLHMGWFRQAPGKEHESVSAISSDGGSEYYAGSVKGRFTISRDNAKNTVYLQMNSLKPEDTAVYYCAADPRRIGANIKYSDYWGQGTQVTVSS

SEQ ID NO: 861 - protein, 252 aa, Artificial Sequence
  Nanobody
EVQLVESGGDLVQTGGSLRLSCAASGITVSDRAMGWYRQAPGKQREMVAGVSRGGMTSYADSVKGRLTISRDNAKNSVYLQMNSLNPEDTAVYYCSAYYRYGSSVPQYWGQGTQVTVSSGGGGSGGGSEVQLVESGGGLVQPGGSLRLSCAASGSTFSINMMAWYCQAPGKQRELVASISSGGGINYADSVKGRFTISRDYAENSVDLQMNSLKPEDTAVYYCNARGTYLNGDHYSTNYNSWGQGTQVTVSS

SEQ ID NO: 862 - protein, 253 aa, Artificial Sequence
  Nanobody
EVQLVESGGGLVQAGGSLRLSCAASGSIFSIKAMGWYRQAPGKQRELVARITSGGSTYYADSVKGRFTISRDNAKNTVYLQMNSLKPEDTAVFYCNAIVTDSDYDLGNDYWGQGTQVTVSSGGGGSGGGSEVQLVESGGGLVQAGDSLRLSCLASGRSFKDDAMGWFRQAPGKEREFVSGIDWRGNIVDAESVKGRFTISRENAKNTLYLQMNHLKPEDTAVYYCAASSVFSDLRYRKNPKYWGQGTQVTVSS

SEQ ID NO: 863 - protein, 258 aa, Artificial Sequence
  Nanobody
EVQLVESGGGLVQAGGSLRLSCAASGSIFSIKAMGWYRQAPGKQRELVARITSGGSTYYADSVKGRFTISRDNAKNTVYLQMNSLKPEDTAVFYCNAIVTDSDYDLGNDYWGQGTQVTVSSGGGGSGGGSEVQLVESGGGLVQPGGSLRLSCAASGVTLDYYAIGWFRQAPGKEREGVSSISSNDGSTFYADSVKGRFTISRDKAKNTVYLQMNSLKPEDTAVYYCAATYLTAQAVGVPVAYYEFDYWGQGTQVTVSS

SEQ ID NO: 864 - protein, 251 aa, Artificial Sequence
  Nanobody
EVQLVESGGGLVQAGGSLRLSCAASGSIFSIKAMGWYRQAPGKQRELVARITSGGSTYYADSVKGRFTISRDNAKNTVYLQMNSLKPEDTAVFYCNAIVTDSDYDLGNDYWGQGTQVTVSSGGGGSGGGSKVQLVESGGGLVQPGGSLRLSCAASGFTFSSYAMSWVRRAPGKGLEWVSAINSDGTGSSYAPFVTGRFTASRDNAKNTLYLQMNSLKPEDTAVYYCTNSNRYDYADFSAVRGQGTQVTVSS

SEQ ID NO: 865 - protein, 253 aa, Artificial Sequence
  Nanobody
EVQLVESGGGLVQAGGSLRLSCAASGSIFSIKAMGWYRQAPGKQRELVARITSGGSTYYADSVKGRFTISRDNAKNTVYLQMNSLKPEDTAVFYCNAIVTDSDYDLGNDYWGQGTQVTVSSGGGGSGGGSEVQLVESGGGLVQAGDSLRLSCVASGLPFSTLHMGWFRQAPGKEHESVSAISSDGGSEYYAGSVKGRFTISRDNAKNTVYLQMNSLKPEDTAVYYCAADPRRIGANIKYSDYWGQGTQVTVSS

SEQ ID NO: 866 - protein, 254 aa, Artificial Sequence
  Nanobody
EVQLVESGGGLVQAGGSLRLSCAASGSIFSIKAMGWYRQAPGKQRELVARITSGGSTYYADSVKGRFTISRDNAKNTVYLQMNSLKPEDTAVFYCNAIVTDSDYDLGNDYWGQGTQVTVSSGGGGSGGGSEVQLVESGGGLVQPGGSLRLSCAASGSTFSINMMAWYCQAPGKQRELVASISSGGGINYADSVKGRFTISRDYAENSVDLQMNSLKPEDTAVYYCNARGTYLNGDHYSTNYNSWGQGTQVTVSS

SEQ ID NO: 867 - protein, 258 aa, Artificial Sequence
  Nanobody
EVQLVESGGGLVEAGGSLRLSCAAAGRTLSSYSMAWFRQAPGKEREFVAIIRGNPSRTYHSDSVKGRFTASRDNAKNTVYLQMNRLEPEDTAVYYCAADPPPFASDYSAPQSYDYWGQGTQVTVSSGGGGSGGGSEVQLVESGGGLVQAGDSLRLSCLASGRSFKDDAMGWFRQAPGKEREFVSGIDWRGNIVDAESVKGRFTISRENAKNTLYLQMNHLKPEDTAVYYCAASSVFSDLRYRKNPKYWGQGTQVTVSS

SEQ ID NO: 868 - protein, 263 aa, Artificial Sequence
  Nanobody
EVQLVESGGGLVEAGGSLRLSCAAAGRTLSSYSMAWFRQAPGKEREFVAIIRGNPSRTYHSDSVKGRFTASRDNAKNTVYLQMNRLEPEDTAVYYCAADPPPFASDYSAPQSYDYWGQGTQVTVSSGGGGSGGGSEVQLVESGGGLVQPGGSLRLSCAASGVTLDYYAIGWFRQAPGKEREGVSSISSNDGSTFYADSVKGRFTISRDKAKNTVYLQMNSLKPEDTAVYYCAATYLTAQAVGVPVAYYEFDYWGQGTQVTVSS

SEQ ID NO: 869 - protein, 256 aa, Artificial Sequence
  Nanobody
EVQLVESGGGLVEAGGSLRLSCAAAGRTLSSYSMAWFRQAPGKEREFVAIIRGNPSRTYHSDSVKGRFTASRDNAKNTVYLQMNRLEPEDTAVYYCAADPPPFASDYSAPQSYDYWGQGTQVTVSSGGGGSGGGSKVQLVESGGGLVQPGGSLRLSCAASGFTFSSYAMSWVRRAPGKGLEWVSAINSDGTGSSYAPFVTGRFTASRDNAKNTLYLQMNSLKPEDTAVYYCTNSNRYDYADFSAVRGQGTQVTVSS

SEQ ID NO: 870 - protein, 258 aa, Artificial Sequence
  Nanobody
EVQLVESGGGLVEAGGSLRLSCAAAGRTLSSYSMAWFRQAPGKEREFVAIIRGNPSRTYHSDSVKGRFTASRDNAKNTVYLQMNRLEPEDTAVYYCAADPPPFASDYSAPQSYDYWGQGTQVTVSSGGGGSGGGSEVQLVESGGGLVQAGDSLRLSCVASGLPFSTLHMGWFRQAPGKEHESVSAISSDGGSEYYAGSVKGRFTISRDNAKNTVYLQMNSLKPEDTAVYYCAADPRRIGANIKYSDYWGQGTQVTVSS

SEQ ID NO: 871 - protein, 259 aa, Artificial Sequence
  Nanobody
EVQLVESGGGLVEAGGSLRLSCAAAGRTLSSYSMAWFRQAPGKEREFVAIIRGNPSRTYHSDSVKGRFTASRDNAKNTVYLQMNRLEPEDTAVYYCAADPPPFASDYSAPQSYDYWGQGTQVTVSSGGGGSGGGSEVQLVESGGGLVQPGGSLRLSCAASGSTFSINMMAWYCQAPGKQRELVASISSGGGINYADSVKGRFTISRDYAENSVDLQMNSLKPEDTAVYYCNARGTYLNGDHYSTNYNSWGQGTQVTVSS

SEQ ID NO: 872 - protein, 251 aa, Artificial Sequence
  Nanobody
EVQLVESGGGLVQPGGSLRLSCAASKSIFDINAMYWHRQAPGKQRESVASITSGGMRNYADSVKDRFTISKDNAKNTVYLQMNGLKPDDTAVYYCGLGRYEGGVWRDYWGQGTQVTVSSGGGGSGGGSEVQLVESGGGLVQAGDSLRLSCLASGRSFKDDAMGWFRQAPGKEREFVSGIDWRGNIVDAESVKGRFTISRENAKNTLYLQMNHLKPEDTAVYYCAASSVFSDLRYRKNPKYWGQGTQVTVSS

SEQ ID NO: 873 - protein, 256 aa, Artificial Sequence
  Nanobody
EVQLVESGGGLVQPGGSLRLSCAASKSIFDINAMYWHRQAPGKQRESVASITSGGMRNYADSVKDRFTISKDNAKNTVYLQMNGLKPDDTAVYYCGLGRYEGGVWRDYWGQGTQVTVSSGGGGSGGGSEVQLVESGGGLVQPGGSLRLSCAASGVTLDYYAIGWFRQAPGKEREGVSSISSNDGSTFYADSVKGRFTISRDKAKNTVYLQMNSLKPEDTAVYYCAATYLTAQAVGVPVAYYEFDYWGQGTQVTVSS

SEQ ID NO: 874 - protein, 249 aa, Artificial Sequence
  Nanobody
EVQLVESGGGLVQPGGSLRLSCAASKSIFDINAMYWHRQAPGKQRESVASITSGGMRNYADSVKDRFTISKDNAKNTVYLQMNGLKPDDTAVYYCGLGRYEGGVWRDYWGQGTQVTVSSGGGGSGGGSKVQLVESGGGLVQPGGSLRLSCAASGFTFSSYAMSWVRRAPGKGLEWVSAINSDGTGSSYAPFVTGRFTASRDNAKNTLYLQMNSLKPEDTAVYYCTNSNRYDYADFSAVRGQGTQVTVSS

SEQ ID NO: 875 - protein, 251 aa, Artificial Sequence
  Nanobody
EVQLVESGGGLVQPGGSLRLSCAASKSIFDINAMYWHRQAPGKQRESVASITSGGMRNYADSVKDRFTISKDNAKNTVYLQMNGLKPDDTAVYYCGLGRYEGGVWRDYWGQGTQVTVSSGGGGSGGGSEVQLVESGGGLVQAGDSLRLSCVASGLPFSTLHMGWFRQAPGKEHESVSAISSDGGSEYYAGSVKGRFTISRDNAKNTVYLQMNSLKPEDTAVYYCAADPRRIGANIKYSDYWGQGTQVTVSS

SEQ ID NO: 876 - protein, 252 aa, Artificial Sequence
  Nanobody
EVQLVESGGGLVQPGGSLRLSCAASKSIFDINAMYWHRQAPGKQRESVASITSGGMRNYADSVKDRFTISKDNAKNTVYLQMNGLKPDDTAVYYCGLGRYEGGVWRDYWGQGTQVTVSSGGGGSGGGSEVQLVESGGGLVQPGGSLRLSCAASGSTFSINMMAWYCQAPGKQRELVASISSGGGINYADSVKGRFTISRDYAENSVDLQMNSLKPEDTAVYYCNARGTYLNGDHYSTNYNSWGQGTQVTVSS

SEQ ID NO: 877 - protein, 248 aa, Artificial Sequence
  Nanobody
EVQLVESGGGLVQAGGSLNLSCNASGDIGSINAMGWYRQAPGQQREWVAVITDTDSTIYPDSVKGRFAISRDGAKNTVHLRMSSLKPEDTAVYYCNAYQAGWGDYWGQGTQVTVSSGGGGSGGGSEVQLVESGGGLVQAGDSLRLSCLASGRSFKDDAMGWFRQAPGKEREFVSGIDWRGNIVDAESVKGRFTISRENAKNTLYLQMNHLKPEDTAVYYCAASSVFSDLRYRKNPKYWGQGTQVTVSS

SEQ ID NO: 878 - protein, 253 aa, Artificial Sequence
  Nanobody
EVQLVESGGGLVQAGGSLNLSCNASGDIGSINAMGWYRQAPGQQREWVAVITDTDSTIYPDSVKGRFAISRDGAKNTVHLRMSSLKPEDTAVYYCNAYQAGWGDYWGQGTQVTVSSGGGGSGGGSEVQLVESGGGLVQPGGSLRLSCAASGVTLDYYAIGWFRQAPGKEREGVSSISSNDGSTFYADSVKGRFTISRDKAKNTVYLQMNSLKPEDTAVYYCAATYLTAQAVGVPVAYYEFDYWGQGTQVTVSS

SEQ ID NO: 879 - protein, 246 aa, Artificial Sequence
  Nanobody
EVQLVESGGGLVQAGGSLNLSCNASGDIGSINAMGWYRQAPGQQREWVAVITDTDSTIYPDSVKGRFAISRDGAKNTVHLRMSSLKPEDTAVYYCNAYQAGWGDYWGQGTQVTVSSGGGGSGGGSKVQLVESGGGLVQPGGSLRLSCAASGFTFSSYAMSWVRRAPGKGLEWVSAINSDGTGSSYAPFVTGRFTASRDNAKNTLYLQMNSLKPEDTAVYYCTNSNRYDYADFSAVRGQGTQVTVSS

SEQ ID NO: 880 - protein, 248 aa, Artificial Sequence
  Nanobody
EVQLVESGGGLVQAGGSLNLSCNASGDIGSINAMGWYRQAPGQQREWVAVITDTDSTIYPDSVKGRFAISRDGAKNTVHLRMSSLKPEDTAVYYCNAYQAGWGDYWGQGTQVTVSSGGGGSGGGSEVQLVESGGGLVQAGDSLRLSCVASGLPFSTLHMGWFRQAPGKEHESVSAISSDGGSEYYAGSVKGRFTISRDNAKNTVYLQMNSLKPEDTAVYYCAADPRRIGANIKYSDYWGQGTQVTVSS

SEQ ID NO: 881 - protein, 249 aa, Artificial Sequence
  Nanobody
EVQLVESGGGLVQAGGSLNLSCNASGDIGSINAMGWYRQAPGQQREWVAVITDTDSTIYPDSVKGRFAISRDGAKNTVHLRMSSLKPEDTAVYYCNAYQAGWGDYWGQGTQVTVSSGGGGSGGGSEVQLVESGGGLVQPGGSLRLSCAASGSTFSINMMAWYCQAPGKQRELVASISSGGGINYADSVKGRFTISRDYAENSVDLQMNSLKPEDTAVYYCNARGTYLNGDHYSTNYNSWGQGTQVTVSS

SEQ ID NO: 882 - protein, 250 aa, Artificial Sequence
  Nanobody
EVQLVESGGGLVQAGGSLRLSCAASGGIFSDMFMGWFRQAPGKSRESVARISPSGNTFYQDSVRGRFTISTDNAKNTVYLQMNNLKPEDTAVYYCAANVGVTGSYEYWGQGTQVTVSSGGGGSGGGSEVQLVESGGGLVQAGDSLRLSCLASGRSFKDDAMGWFRQAPGKEREFVSGIDWRGNIVDAESVKGRFTISRENAKNTLYLQMNHLKPEDTAVYYCAASSVFSDLRYRKNPKYWGQGTQVTVSS

SEQ ID NO: 883 - protein, 255 aa, Artificial Sequence
  Nanobody
EVQLVESGGGLVQAGGSLRLSCAASGGIFSDMFMGWFRQAPGKSRESVARISPSGNTFYQDSVRGRFTISTDNAKNTVYLQMNNLKPEDTAVYYCAANVGVTGSYEYWGQGTQVTVSSGGGGSGGGSEVQLVESGGGLVQPGGSLRLSCAASGVTLDYYAIGWFRQAPGKEREGVSSISSNDGSTFYADSVKGRFTISRDKAKNTVYLQMNSLKPEDTAVYYCAATYLTAQAVGVPVAYYEFDYWGQGTQVTVSS

SEQ ID NO: 884 - protein, 248 aa, Artificial Sequence
  Nanobody
EVQLVESGGGLVQAGGSLRLSCAASGGIFSDMFMGWFRQAPGKSRESVARISPSGNTFYQDSVRGRFTISTDNAKNTVYLQMNNLKPEDTAVYYCAANVGVTGSYEYWGQGTQVTVSSGGGGSGGGSKVQLVESGGGLVQPGGSLRLSCAASGFTFSSYAMSWVRRAPGKGLEWVSAINSDGTGSSYAPFVTGRFTASRDNAKNTLYLQMNSLKPEDTAVYYCTNSNRYDYADFSAVRGQGTQVTVSS

SEQ ID NO: 885 - protein, 250 aa, Artificial Sequence
  Nanobody
EVQLVESGGGLVQAGGSLRLSCAASGGIFSDMFMGWFRQAPGKSRESVARISPSGNTFYQDSVRGRFTISTDNAKNTVYLQMNNLKPEDTAVYYCAANVGVTGSYEYWGQGTQVTVSSGGGGSGGGSEVQLVESGGGLVQAGDSLRLSCVASGLPFSTLHMGWFRQAPGKEHESVSAISSDGGSEYYAGSVKGRFTISRDNAKNTVYLQMNSLKPEDTAVYYCAADPRRIGANIKYSDYWGQGTQVTVSS

SEQ ID NO: 886 - protein, 251 aa, Artificial Sequence
  Nanobody
EVQLVESGGGLVQAGGSLRLSCAASGGIFSDMFMGWFRQAPGKSRESVARISPSGNTFYQDSVRGRFTISTDNAKNTVYLQMNNLKPEDTAVYYCAANVGVTGSYEYWGQGTQVTVSSGGGGSGGGSEVQLVESGGGLVQPGGSLRLSCAASGSTFSINMMAWYCQAPGKQRELVASISSGGGINYADSVKGRFTISRDYAENSVDLQMNSLKPEDTAVYYCNARGTYLNGDHYSTNYNSWGQGTQVTVSS

SEQ ID NO: 887 - protein, 286 aa, Artificial Sequence
  Nanobody
EVQLVESGGGLVQAGGSLSLSCATSGRTISDDTMAWFRQAPGKEREFVAIITFNGARTHYSDSVRDRFTISRDNAKNTVYLQMNSLKSEDTAVYYCAASTKYYSSTYNYIHPAFYDIWGQGTQVTVSSGGGGSGGGGSGGGGSGGGGSGGGGSGGGGSGGGGSEVQLVESGGGLVQAGDSLRLSCLASGRSFKDDAMGWFRQAPGKEREFVSGIDWRGNIVDAESVKGRFTISRENAKNTLYLQMNHLKPEDTAVYYCAASSVFSDLRYRKNPKYWGQGTQVTVSS

SEQ ID NO: 888 - protein, 291 aa, Artificial Sequence
  Nanobody
EVQLVESGGGLVQAGGSLSLSCATSGRTISDDTMAWFRQAPGKEREFVAIITFNGARTHYSDSVRDRFTISRDNAKNTVYLQMNSLKSEDTAVYYCAASTKYYSSTYNYIHPAFYDIWGQGTQVTVSSGGGGSGGGGSGGGGSGGGGSGGGGSGGGGSGGGGSEVQLVESGGGLVQPGGSLRLSCAASGVTLDYYAIGWFRQAPGKEREGVSSISSNDGSTFYADSVKGRFTISRDKAKNTVYLQMNSLKPEDTAVYYCAATYLTAQAVGVPVAYYEFDYWGQGTQVTVSS

SEQ ID NO: 889 - protein, 284 aa, Artificial Sequence
  Nanobody
EVQLVESGGGLVQAGGSLSLSCATSGRTISDDTMAWFRQAPGKEREFVAIITFNGARTHYSDSVRDRFTISRDNAKNTVYLQMNSLKSEDTAVYYCAASTKYYSSTYNYIHPAFYDIWGQGTQVTVSSGGGGSGGGGSGGGGSGGGGSGGGGSGGGGSGGGGSKVQLVESGGGLVQPGGSLRLSCAASGFTFSSYAMSWVRRAPGKGLEWVSAINSDGTGSSYAPFVTGRFTASRDNAKNTLYLQMNSLKPEDTAVYYCTNSNRYDYADFSAVRGQGTQVTVSS

SEQ ID NO: 890 - protein, 286 aa, Artificial Sequence
  Nanobody
EVQLVESGGGLVQAGGSLSLSCATSGRTISDDTMAWFRQAPGKEREFVAIITFNGARTHYSDSVRDRFTISRDNAKNTVYLQMNSLKSEDTAVYYCAASTKYYSSTYNYIHPAFYDIWGQGTQVTVSSGGGGSGGGGSGGGGSGGGGSGGGGSGGGGSGGGGSEVQLVESGGGLVQAGDSLRLSCVASGLPFSTLHMGWFRQAPGKEHESVSAISSDGGSEYYAGSVKGRFTISRDNAKNTVYLQMNSLKPEDTAVYYCAADPRRIGANIKYSDYWGQGTQVTVSS

SEQ ID NO: 891 - protein, 287 aa, Artificial Sequence
  Nanobody
EVQLVESGGGLVQAGGSLSLSCATSGRTISDDTMAWFRQAPGKEREFVAIITFNGARTHYSDSVRDRFTISRDNAKNTVYLQMNSLKSEDTAVYYCAASTKYYSSTYNYIHPAFYDIWGQGTQVTVSSGGGGSGGGGSGGGGSGGGGSGGGGSGGGGSGGGGSEVQLVESGGGLVQPGGSLRLSCAASGSTFSINMMAWYCQAPGKQRELVASISSGGGINYADSVKGRFTISRDYAENSVDLQMNSLKPEDTAVYYCNARGTYLNGDHYSTNYNSWGQGTQVTVSS

SEQ ID NO: 892 - protein, 277 aa, Artificial Sequence
  Nanobody
EVQLVESGGDLVQTGGSLRLSCAASGITVSDRAMGWYRQAPGKQREMVAGVSRGGMTSYADSVKGRLTISRDNAKNSVYLQMNSLNPEDTAVYYCSAYYRYGSSVPQYWGQGTQVTVSSGGGGSGGGGSGGGGSGGGGSGGGGSGGGGSGGGGSEVQLVESGGGLVQAGDSLRLSCLASGRSFKDDAMGWFRQAPGKEREFVSGIDWRGNIVDAESVKGRFTISRENAKNTLYLQMNHLKPEDTAVYYCAASSVFSDLRYRKNPKYWGQGTQVTVSS

SEQ ID NO: 893 - protein, 282 aa, Artificial Sequence
  Nanobody
EVQLVESGGDLVQTGGSLRLSCAASGITVSDRAMGWYRQAPGKQREMVAGVSRGGMTSYADSVKGRLTISRDNAKNSVYLQMNSLNPEDTAVYYCSAYYRYGSSVPQYWGQGTQVTVSSGGGGSGGGGSGGGGSGGGGSGGGGSGGGGSGGGGSEVQLVESGGGLVQPGGSLRLSCAASGVTLDYYAIGWFRQAPGKEREGVSSISSNDGSTFYADSVKGRFTISRDKAKNTVYLQMNSLKPEDTAVYYCAATYLTAQAVGVPVAYYEFDYWGQGTQVTVSS

SEQ ID NO: 894 - protein, 275 aa, Artificial Sequence
  Nanobody
EVQLVESGGDLVQTGGSLRLSCAASGITVSDRAMGWYRQAPGKQREMVAGVSRGGMTSYADSVKGRLTISRDNAKNSVYLQMNSLNPEDTAVYYCSAYYRYGSSVPQYWGQGTQVTVSSGGGGSGGGGSGGGGSGGGGSGGGGSGGGGSGGGGSKVQLVESGGGLVQPGGSLRLSCAASGFTFSSYAMSWVRRAPGKGLEWVSAINSDGTGSSYAPFVTGRFTASRDNAKNTLYLQMNSLKPEDTAVYYCTNSNRYDYADFSAVRGQGTQVTVSS

SEQ ID NO: 895 - protein, 277 aa, Artificial Sequence
  Nanobody
EVQLVESGGDLVQTGGSLRLSCAASGITVSDRAMGWYRQAPGKQREMVAGVSRGGMTSYADSVKGRLTISRDNAKNSVYLQMNSLNPEDTAVYYCSAYYRYGSSVPQYWGQGTQVTVSSGGGGSGGGGSGGGGSGGGGSGGGGSGGGGSGGGGSEVQLVESGGGLVQAGDSLRLSCVASGLPFSTLHMGWFRQAPGKEHESVSAISSDGGSEYYAGSVKGRFTISRDNAKNTVYLQMNSLKPEDTAVYYCAADPRRIGANIKYSDYWGQGTQVTVSS

SEQ ID NO: 896 - protein, 278 aa, Artificial Sequence
  Nanobody
EVQLVESGGDLVQTGGSLRLSCAASGITVSDRAMGWYRQAPGKQREMVAGVSRGGMTSYADSVKGRLTISRDNAKNSVYLQMNSLNPEDTAVYYCSAYYRYGSSVPQYWGQGTQVTVSSGGGGSGGGGSGGGGSGGGGSGGGGSGGGGSGGGGSEVQLVESGGGLVQPGGSLRLSCAASGSTFSINMMAWYCQAPGKQRELVASISSGGGINYADSVKGRFTISRDYAENSVDLQMNSLKPEDTAVYYCNARGTYLNGDHYSTNYNSWGQGTQVTVSS

SEQ ID NO: 897 - protein, 279 aa, Artificial Sequence
  Nanobody
EVQLVESGGGLVQAGGSLRLSCAASGSIFSIKAMGWYRQAPGKQRELVARITSGGSTYYADSVKGRFTISRDNAKNTVYLQMNSLKPEDTAVFYCNAIVTDSDYDLGNDYWGQGTQVTVSSGGGGSGGGGSGGGGSGGGGSGGGGSGGGGSGGGGSEVQLVESGGGLVQAGDSLRLSCLASGRSFKDDAMGWFRQAPGKEREFVSGIDWRGNIVDAESVKGRFTISRENAKNTLYLQMNHLKPEDTAVYYCAASSVFSDLRYRKNPKYWGQGTQVTVSS

SEQ ID NO: 898 - protein, 284 aa, Artificial Sequence
  Nanobody
EVQLVESGGGLVQAGGSLRLSCAASGSIFSIKAMGWYRQAPGKQRELVARITSGGSTYYADSVKGRFTISRDNAKNTVYLQMNSLKPEDTAVFYCNAIVTDSDYDLGNDYWGQGTQVTVSSGGGGSGGGGSGGGGSGGGGSGGGGSGGGGSGGGGSEVQLVESGGGLVQPGGSLRLSCAASGVTLDYYAIGWFRQAPGKEREGVSSISSNDGSTFYADSVKGRFTISRDKAKNTVYLQMNSLKPEDTAVYYCAATYLTAQAVGVPVAYYEFDYWGQGTQVTVSS

SEQ ID NO: 899 - protein, 277 aa, Artificial Sequence
  Nanobody
EVQLVESGGGLVQAGGSLRLSCAASGSIFSIKAMGWYRQAPGKQRELVARITSGGSTYYADSVKGRFTISRDNAKNTVYLQMNSLKPEDTAVFYCNAIVTDSDYDLGNDYWGQGTQVTVSSGGGGSGGGGSGGGGSGGGGSGGGGSGGGGSGGGGSKVQLVESGGGLVQPGGSLRLSCAASGFTFSSYAMSWVRRAPGKGLEWVSAINSDGTGSSYAPFVTGRFTASRDNAKNTLYLQMNSLKPEDTAVYYCTNSNRYDYADFSAVRGQGTQVTVSS

SEQ ID NO: 900 - protein, 279 aa, Artificial Sequence
  Nanobody
EVQLVESGGGLVQAGGSLRLSCAASGSIFSIKAMGWYRQAPGKQRELVARITSGGSTYYADSVKGRFTISRDNAKNTVYLQMNSLKPEDTAVFYCNAIVTDSDYDLGNDYWGQGTQVTVSSGGGGSGGGGSGGGGSGGGGSGGGGSGGGGSGGGGSEVQLVESGGGLVQAGDSLRLSCVASGLPFSTLHMGWFRQAPGKEHESVSAISSDGGSEYYAGSVKGRFTISRDNAKNTVYLQMNSLKPEDTAVYYCAADPRRIGANIKYSDYWGQGTQVTVSS

SEQ ID NO: 901 - protein, 280 aa, Artificial Sequence
  Nanobody
EVQLVESGGGLVQAGGSLRLSCAASGSIFSIKAMGWYRQAPGKQRELVARITSGGSTYYADSVKGRFTISRDNAKNTVYLQMNSLKPEDTAVFYCNAIVTDSDYDLGNDYWGQGTQVTVSSGGGGSGGGGSGGGGSGGGGSGGGGSGGGGSGGGGSEVQLVESGGGLVQPGGSLRLSCAASGSTFSINMMAWYCQAPGKQRELVASISSGGGINYADSVKGRFTISRDYAENSVDLQMNSLKPEDTAVYYCNARGTYLNGDHYSTNYNSWGQGTQVTVSS

SEQ ID NO: 902 - protein, 284 aa, Artificial Sequence
  Nanobody
EVQLVESGGGLVEAGGSLRLSCAAAGRTLSSYSMAWFRQAPGKEREFVAIIRGNPSRTYHSDSVKGRFTASRDNAKNTVYLQMNRLEPEDTAVYYCAADPPPFASDYSAPQSYDYWGQGTQVTVSSGGGGSGGGGSGGGGSGGGGSGGGGSGGGGSGGGGSEVQLVESGGGLVQAGDSLRLSCLASGRSFKDDAMGWFRQAPGKEREFVSGIDWRGNIVDAESVKGRFTISRENAKNTLYLQMNHLKPEDTAVYYCAASSVFSDLRYRKNPKYWGQGTQVTVSS

SEQ ID NO: 903 - protein, 289 aa, Artificial Sequence
  Nanobody
EVQLVESGGGLVEAGGSLRLSCAAAGRTLSSYSMAWFRQAPGKEREFVAIIRGNPSRTYHSDSVKGRFTASRDNAKNTVYLQMNRLEPEDTAVYYCAADPPPFASDYSAPQSYDYWGQGTQVTVSSGGGGSGGGGSGGGGSGGGGSGGGGSGGGGSGGGGSEVQLVESGGGLVQPGGSLRLSCAASGVTLDYYAIGWFRQAPGKEREGVSSISSNDGSTFYADSVKGRFTISRDKAKNTVYLQMNSLKPEDTAVYYCAATYLTAQAVGVPVAYYEFDYWGQGTQVTVSS

SEQ ID NO: 904 - protein, 282 aa, Artificial Sequence
  Nanobody
EVQLVESGGGLVEAGGSLRLSCAAAGRTLSSYSMAWFRQAPGKEREFVAIIRGNPSRTYHSDSVKGRFTASRDNAKNTVYLQMNRLEPEDTAVYYCAADPPPFASDYSAPQSYDYWGQGTQVTVSSGGGGSGGGGSGGGGSGGGGSGGGGSGGGGSGGGGSKVQLVESGGGLVQPGGSLRLSCAASGFTFSSYAMSWVRRAPGKGLEWVSAINSDGTGSSYAPFVTGRFTASRDNAKNTLYLQMNSLKPEDTAVYYCTNSNRYDYADFSAVRGQGTQVTVSS

SEQ ID NO: 905 - protein, 284 aa, Artificial Sequence
  Nanobody
EVQLVESGGGLVEAGGSLRLSCAAAGRTLSSYSMAWFRQAPGKEREFVAIIRGNPSRTYHSDSVKGRFTASRDNAKNTVYLQMNRLEPEDTAVYYCAADPPPFASDYSAPQSYDYWGQGTQVTVSSGGGGSGGGGSGGGGSGGGGSGGGGSGGGGSGGGGSEVQLVESGGGLVQAGDSLRLSCVASGLPFSTLHMGWFRQAPGKEHESVSAISSDGGSEYYAGSVKGRFTISRDNAKNTVYLQMNSLKPEDTAVYYCAADPRRIGANIKYSDYWGQGTQVTVSS

SEQ ID NO: 906 - protein, 285 aa, Artificial Sequence
  Nanobody
EVQLVESGGGLVEAGGSLRLSCAAAGRTLSSYSMAWFRQAPGKEREFVAIIRGNPSRTYHSDSVKGRFTASRDNAKNTVYLQMNRLEPEDTAVYYCAADPPPFASDYSAPQSYDYWGQGTQVTVSSGGGGSGGGGSGGGGSGGGGSGGGGSGGGGSGGGGSEVQLVESGGGLVQPGGSLRLSCAASGSTFSINMMAWYCQAPGKQRELVASISSGGGINYADSVKGRFTISRDYAENSVDLQMNSLKPEDTAVYYCNARGTYLNGDHYSTNYNSWGQGTQVTVSS

SEQ ID NO: 907 - protein, 277 aa, Artificial Sequence
  Nanobody
EVQLVESGGGLVQPGGSLRLSCAASKSIFDINAMYWHRQAPGKQRESVASITSGGMRNYADSVKDRFTISKDNAKNTVYLQMNGLKPDDTAVYYCGLGRYEGGVWRDYWGQGTQVTVSSGGGGSGGGGSGGGGSGGGGSGGGGSGGGGSGGGGSEVQLVESGGGLVQAGDSLRLSCLASGRSFKDDAMGWFRQAPGKEREFVSGIDWRGNIVDAESVKGRFTISRENAKNTLYLQMNHLKPEDTAVYYCAASSVFSDLRYRKNPKYWGQGTQVTVSS

SEQ ID NO: 908 - protein, 282 aa, Artificial Sequence
  Nanobody
EVQLVESGGGLVQPGGSLRLSCAASKSIFDINAMYWHRQAPGKQRESVASITSGGMRNYADSVKDRFTISKDNAKNTVYLQMNGLKPDDTAVYYCGLGRYEGGVWRDYWGQGTQVTVSSGGGGSGGGGSGGGGSGGGGSGGGGSGGGGSGGGGSEVQLVESGGGLVQPGGSLRLSCAASGVTLDYYAIGWFRQAPGKEREGVSSISSNDGSTFYADSVKGRFTISRDKAKNTVYLQMNSLKPEDTAVYYCAATYLTAQAVGVPVAYYEFDYWGQGTQVTVSS

SEQ ID NO: 909 - protein, 275 aa, Artificial Sequence
  Nanobody
EVQLVESGGGLVQPGGSLRLSCAASKSIFDINAMYWHRQAPGKQRESVASITSGGMRNYADSVKDRFTISKDNAKNTVYLQMNGLKPDDTAVYYCGLGRYEGGVWRDYWGQGTQVTVSSGGGGSGGGGSGGGGSGGGGSGGGGSGGGGSGGGGSKVQLVESGGGLVQPGGSLRLSCAASGFTFSSYAMSWVRRAPGKGLEWVSAINSDGTGSSYAPFVTGRFTASRDNAKNTLYLQMNSLKPEDTAVYYCTNSNRYDYADFSAVRGQGTQVTVSS

SEQ ID NO: 910 - protein, 277 aa, Artificial Sequence
  Nanobody
EVQLVESGGGLVQPGGSLRLSCAASKSIFDINAMYWHRQAPGKQRESVASITSGGMRNYADSVKDRFTISKDNAKNTVYLQMNGLKPDDTAVYYCGLGRYEGGVWRDYWGQGTQVTVSSGGGGSGGGGSGGGGSGGGGSGGGGSGGGGSGGGGSEVQLVESGGGLVQAGDSLRLSCVASGLPFSTLHMGWFRQAPGKEHESVSAISSDGGSEYYAGSVKGRFTISRDNAKNTVYLQMNSLKPEDTAVYYCAADPRRIGANIKYSDYWGQGTQVTVSS

SEQ ID NO: 911 - protein, 278 aa, Artificial Sequence
  Nanobody
EVQLVESGGGLVQPGGSLRLSCAASKSIFDINAMYWHRQAPGKQRESVASITSGGMRNYADSVKDRFTISKDNAKNTVYLQMNGLKPDDTAVYYCGLGRYEGGVWRDYWGQGTQVTVSSGGGGSGGGGSGGGGSGGGGSGGGGSGGGGSGGGGSEVQLVESGGGLVQPGGSLRLSCAASGSTFSINMMAWYCQAPGKQRELVASISSGGGINYADSVKGRFTISRDYAENSVDLQMNSLKPEDTAVYYCNARGTYLNGDHYSTNYNSWGQGTQVTVSS

SEQ ID NO: 912 - protein, 274 aa, Artificial Sequence
  Nanobody
EVQLVESGGGLVQAGGSLNLSCNASGDIGSINAMGWYRQAPGQQREWVAVITDTDSTIYPDSVKGRFAISRDGAKNTVHLRMSSLKPEDTAVYYCNAYQAGWGDYWGQGTQVTVSSGGGGSGGGGSGGGGSGGGGSGGGGSGGGGSGGGGSEVQLVESGGGLVQAGDSLRLSCLASGRSFKDDAMGWFRQAPGKEREFVSGIDWRGNIVDAESVKGRFTISRENAKNTLYLQMNHLKPEDTAVYYCAASSVFSDLRYRKNPKYWGQGTQVTVSS

SEQ ID NO: 913 - protein, 279 aa, Artificial Sequence
  Nanobody
EVQLVESGGGLVQAGGSLNLSCNASGDIGSINAMGWYRQAPGQQREWVAVITDTDSTIYPDSVKGRFAISRDGAKNTVHLRMSSLKPEDTAVYYCNAYQAGWGDYWGQGTQVTVSSGGGGSGGGGSGGGGSGGGGSGGGGSGGGGSGGGGSEVQLVESGGGLVQPGGSLRLSCAASGVTLDYYAIGWFRQAPGKEREGVSSISSNDGSTFYADSVKGRFTISRDKAKNTVYLQMNSLKPEDTAVYYCAATYLTAQAVGVPVAYYEFDYWGQGTQVTVSS

SEQ ID NO: 914 - protein, 272 aa, Artificial Sequence
  Nanobody
EVQLVESGGGLVQAGGSLNLSCNASGDIGSINAMGWYRQAPGQQREWVAVITDTDSTIYPDSVKGRFAISRDGAKNTVHLRMSSLKPEDTAVYYCNAYQAGWGDYWGQGTQVTVSSGGGGSGGGGSGGGGSGGGGSGGGGSGGGGSGGGGSKVQLVESGGGLVQPGGSLRLSCAASGFTFSSYAMSWVRRAPGKGLEWVSAINSDGTGSSYAPFVTGRFTASRDNAKNTLYLQMNSLKPEDTAVYYCTNSNRYDYADFSAVRGQGTQVTVSS

SEQ ID NO: 915 - protein, 274 aa, Artificial Sequence
  Nanobody
EVQLVESGGGLVQAGGSLNLSCNASGDIGSINAMGWYRQAPGQQREWVAVITDTDSTIYPDSVKGRFAISRDGAKNTVHLRMSSLKPEDTAVYYCNAYQAGWGDYWGQGTQVTVSSGGGGSGGGGSGGGGSGGGGSGGGGSGGGGSGGGGSEVQLVESGGGLVQAGDSLRLSCVASGLPFSTLHMGWFRQAPGKEHESVSAISSDGGSEYYAGSVKGRFTISRDNAKNTVYLQMNSLKPEDTAVYYCAADPRRIGANIKYSDYWGQGTQVTVSS

SEQ ID NO: 916 - protein, 275 aa, Artificial Sequence
  Nanobody
EVQLVESGGGLVQAGGSLNLSCNASGDIGSINAMGWYRQAPGQQREWVAVITDTDSTIYPDSVKGRFAISRDGAKNTVHLRMSSLKPEDTAVYYCNAYQAGWGDYWGQGTQVTVSSGGGGSGGGGSGGGGSGGGGSGGGGSGGGGSGGGGSEVQLVESGGGLVQPGGSLRLSCAASGSTFSINMMAWYCQAPGKQRELVASISSGGGINYADSVKGRFTISRDYAENSVDLQMNSLKPEDTAVYYCNARGTYLNGDHYSTNYNSWGQGTQVTVSS

SEQ ID NO: 917 - protein, 276 aa, Artificial Sequence
  Nanobody
EVQLVESGGGLVQAGGSLRLSCAASGGIFSDMFMGWFRQAPGKSRESVARISPSGNTFYQDSVRGRFTISTDNAKNTVYLQMNNLKPEDTAVYYCAANVGVTGSYEYWGQGTQVTVSSGGGGSGGGGSGGGGSGGGGSGGGGSGGGGSGGGGSEVQLVESGGGLVQAGDSLRLSCLASGRSFKDDAMGWFRQAPGKEREFVSGIDWRGNIVDAESVKGRFTISRENAKNTLYLQMNHLKPEDTAVYYCAASSVFSDLRYRKNPKYWGQGTQVTVSS

SEQ ID NO: 918 - protein, 281 aa, Artificial Sequence
  Nanobody
EVQLVESGGGLVQAGGSLRLSCAASGGIFSDMFMGWFRQAPGKSRESVARISPSGNTFYQDSVRGRFTISTDNAKNTVYLQMNNLKPEDTAVYYCAANVGVTGSYEYWGQGTQVTVSSGGGGSGGGGSGGGGSGGGGSGGGGSGGGGSGGGGSEVQLVESGGGLVQPGGSLRLSCAASGVTLDYYAIGWFRQAPGKEREGVSSISSNDGSTFYADSVKGRFTISRDKAKNTVYLQMNSLKPEDTAVYYCAATYLTAQAVGVPVAYYEFDYWGQGTQVTVSS

SEQ ID NO: 919 - protein, 274 aa, Artificial Sequence
  Nanobody
EVQLVESGGGLVQAGGSLRLSCAASGGIFSDMFMGWFRQAPGKSRESVARISPSGNTFYQDSVRGRFTISTDNAKNTVYLQMNNLKPEDTAVYYCAANVGVTGSYEYWGQGTQVTVSSGGGGSGGGGSGGGGSGGGGSGGGGSGGGGSGGGGSKVQLVESGGGLVQPGGSLRLSCAASGFTFSSYAMSWVRRAPGKGLEWVSAINSDGTGSSYAPFVTGRFTASRDNAKNTLYLQMNSLKPEDTAVYYCTNSNRYDYADFSAVRGQGTQVTVSS

SEQ ID NO: 920 - protein, 276 aa, Artificial Sequence
  Nanobody
EVQLVESGGGLVQAGGSLRLSCAASGGIFSDMFMGWFRQAPGKSRESVARISPSGNTFYQDSVRGRFTISTDNAKNTVYLQMNNLKPEDTAVYYCAANVGVTGSYEYWGQGTQVTVSSGGGGSGGGGSGGGGSGGGGSGGGGSGGGGSGGGGSEVQLVESGGGLVQAGDSLRLSCVASGLPFSTLHMGWFRQAPGKEHESVSAISSDGGSEYYAGSVKGRFTISRDNAKNTVYLQMNSLKPEDTAVYYCAADPRRIGANIKYSDYWGQGTQVTVSS

SEQ ID NO: 921 - protein, 277 aa, Artificial Sequence
  Nanobody
EVQLVESGGGLVQAGGSLRLSCAASGGIFSDMFMGWFRQAPGKSRESVARISPSGNTFYQDSVRGRFTISTDNAKNTVYLQMNNLKPEDTAVYYCAANVGVTGSYEYWGQGTQVTVSSGGGGSGGGGSGGGGSGGGGSGGGGSGGGGSGGGGSEVQLVESGGGLVQPGGSLRLSCAASGSTFSINMMAWYCQAPGKQRELVASISSGGGINYADSVKGRFTISRDYAENSVDLQMNSLKPEDTAVYYCNARGTYLNGDHYSTNYNSWGQGTQVTVSS

SEQ ID NO: 922 - protein, 256 aa, Artificial Sequence
  Nanobody
EVQLVESGGGLVQAGGSLSLSCATSGRTISDDTMAWFRQAPGKEREFVAIITFNGARTHYSDSVRDRFTISRDNAKNTVYLQMNSLKSEDTAVYYCAASTKYYSSTYNYIHPAFYDIWGQGTQVTVSSGGGGSGGGSEVQLVESGGGLVQAGGSLRLSCAASGRGFSPYTMGWFRQAPGKERVFVAGISWSTGIAHYTDSVKGRFTISRDNAKNTGSLQMNSLKPEDTAVYYCAVVQTTKGNYDYWGQGTQVTVSS

SEQ ID NO: 923 - protein, 256 aa, Artificial Sequence
  Nanobody
EVQLVESGGGLVQAGGSLSLSCATSGRTISDDTMAWFRQAPGKEREFVAIITFNGARTHYSDSVRDRFTISRDNAKNTVYLQMNSLKSEDTAVYYCAASTKYYSSTYNYIHPAFYDIWGQGTQVTVSSGGGGSGGGSEVQLVESGGDLVQTGGSLRLSCAASGITVSDRAMGWYRQAPGKQREMVAGVSRGGMTSYADSVKGRLTISRDNAKNSVYLQMNSLNPEDTAVYYCSAYYRYGSSVPQYWGQGTQVTVSS

SEQ ID NO: 924 - protein, 258 aa, Artificial Sequence
  Nanobody
EVQLVESGGGLVQAGGSLSLSCATSGRTISDDTMAWFRQAPGKEREFVAIITFNGARTHYSDSVRDRFTISRDNAKNTVYLQMNSLKSEDTAVYYCAASTKYYSSTYNYIHPAFYDIWGQGTQVTVSSGGGGSGGGSEVQLVESGGGLVQAGGSLRLSCAASGSIFSIKAMGWYRQAPGKQRELVARITSGGSTYYADSVKGRFTISRDNAKNTVYLQMNSLKPEDTAVFYCNAIVTDSDYDLGNDYWGQGTQVTVSS

SEQ ID NO: 925 - protein, 263 aa, Artificial Sequence
  Nanobody
EVQLVESGGGLVQAGGSLSLSCATSGRTISDDTMAWFRQAPGKEREFVAIITFNGARTHYSDSVRDRFTISRDNAKNTVYLQMNSLKSEDTAVYYCAASTKYYSSTYNYIHPAFYDIWGQGTQVTVSSGGGGSGGGSEVQLVESGGGLVQAGGSLRLSCAASGFAFDDYAIGWFRQAPGKEREGVSSISSSNGNTYYADSVRGRFTISSDNAKNTVYLQMNSLKPEDTGVYYCAAIWGIFFNEKMPVGAYDYWGQGTQVTVSS

SEQ ID NO: 926 - protein, 263 aa, Artificial Sequence
  Nanobody
EVQLVESGGGLVQAGGSLSLSCATSGRTISDDTMAWFRQAPGKEREFVAIITFNGARTHYSDSVRDRFTISRDNAKNTVYLQMNSLKSEDTAVYYCAASTKYYSSTYNYIHPAFYDIWGQGTQVTVSSGGGGSGGGSEVQLVESGGGLVEAGGSLRLSCAAAGRTLSSYSMAWFRQAPGKEREFVAIIRGNPSRTYHSDSVKGRFTASRDNAKNTVYLQMNRLEPEDTAVYYCAADPPPFASDYSAPQSYDYWGQGTQVTVSS

SEQ ID NO: 927 - protein, 247 aa, Artificial Sequence
  Nanobody
EVQLVESGGDLVQTGGSLRLSCAASGITVSDRAMGWYRQAPGKQREMVAGVSRGGMTSYADSVKGRLTISRDNAKNSVYLQMNSLNPEDTAVYYCSAYYRYGSSVPQYWGQGTQVTVSSGGGGSGGGSEVQLVESGGGLVQAGGSLRLSCAASGRGFSPYTMGWFRQAPGKERVFVAGISWSTGIAHYTDSVKGRFTISRDNAKNTGSLQMNSLKPEDTAVYYCAVVQTTKGNYDYWGQGTQVTVSS

SEQ ID NO: 928 - protein, 249 aa, Artificial Sequence
  Nanobody
EVQLVESGGDLVQTGGSLRLSCAASGITVSDRAMGWYRQAPGKQREMVAGVSRGGMTSYADSVKGRLTISRDNAKNSVYLQMNSLNPEDTAVYYCSAYYRYGSSVPQYWGQGTQVTVSSGGGGSGGGSEVQLVESGGGLVQAGGSLRLSCAASGSIFSIKAMGWYRQAPGKQRELVARITSGGSTYYADSVKGRFTISRDNAKNTVYLQMNSLKPEDTAVFYCNAIVTDSDYDLGNDYWGQGTQVTVSS

SEQ ID NO: 929 - protein, 254 aa, Artificial Sequence
  Nanobody
EVQLVESGGDLVQTGGSLRLSCAASGITVSDRAMGWYRQAPGKQREMVAGVSRGGMTSYADSVKGRLTISRDNAKNSVYLQMNSLNPEDTAVYYCSAYYRYGSSVPQYWGQGTQVTVSSGGGGSGGGSEVQLVESGGGLVQAGGSLRLSCAASGFAFDDYAIGWFRQAPGKEREGVSSISSSNGNTYYADSVRGRFTISSDNAKNTVYLQMNSLKPEDTGVYYCAAIWGIFFNEKMPVGAYDYWGQGTQVTVSS

SEQ ID NO: 930 - protein, 254 aa, Artificial Sequence
  Nanobody
EVQLVESGGDLVQTGGSLRLSCAASGITVSDRAMGWYRQAPGKQREMVAGVSRGGMTSYADSVKGRLTISRDNAKNSVYLQMNSLNPEDTAVYYCSAYYRYGSSVPQYWGQGTQVTVSSGGGGSGGGSEVQLVESGGGLVEAGGSLRLSCAAAGRTLSSYSMAWFRQAPGKEREFVAIIRGNPSRTYHSDSVKGRFTASRDNAKNTVYLQMNRLEPEDTAVYYCAADPPPFASDYSAPQSYDYWGQGTQVTVSS

SEQ ID NO: 931 - protein, 249 aa, Artificial Sequence
  Nanobody
EVQLVESGGGLVQAGGSLRLSCAASGSIFSIKAMGWYRQAPGKQRELVARITSGGSTYYADSVKGRFTISRDNAKNTVYLQMNSLKPEDTAVFYCNAIVTDSDYDLGNDYWGQGTQVTVSSGGGGSGGGSEVQLVESGGGLVQAGGSLRLSCAASGRGFSPYTMGWFRQAPGKERVFVAGISWSTGIAHYTDSVKGRFTISRDNAKNTGSLQMNSLKPEDTAVYYCAVVQTTKGNYDYWGQGTQVTVSS

SEQ ID NO: 932 - protein, 256 aa, Artificial Sequence
  Nanobody
EVQLVESGGGLVQAGGSLRLSCAASGSIFSIKAMGWYRQAPGKQRELVARITSGGSTYYADSVKGRFTISRDNAKNTVYLQMNSLKPEDTAVFYCNAIVTDSDYDLGNDYWGQGTQVTVSSGGGGSGGGSEVQLVESGGGLVQAGGSLRLSCAASGFAFDDYAIGWFRQAPGKEREGVSSISSSNGNTYYADSVRGRFTISSDNAKNTVYLQMNSLKPEDTGVYYCAAIWGIFFNEKMPVGAYDYWGQGTQVTVSS

SEQ ID NO: 933 - protein, 256 aa, Artificial Sequence
  Nanobody
EVQLVESGGGLVQAGGSLRLSCAASGSIFSIKAMGWYRQAPGKQRELVARITSGGSTYYADSVKGRFTISRDNAKNTVYLQMNSLKPEDTAVFYCNAIVTDSDYDLGNDYWGQGTQVTVSSGGGGSGGGSEVQLVESGGGLVEAGGSLRLSCAAAGRTLSSYSMAWFRQAPGKEREFVAIIRGNPSRTYHSDSVKGRFTASRDNAKNTVYLQMNRLEPEDTAVYYCAADPPPFASDYSAPQSYDYWGQGTQVTVSS

SEQ ID NO: 934 - protein, 282 aa, Artificial Sequence
  Nanobody
EVQLVESGGGLVQAGGSLSLSCATSGRTISDDTMAWFRQAPGKEREFVAIITFNGARTHYSDSVRDRFTISRDNAKNTVYLQMNSLKSEDTAVYYCAASTKYYSSTYNYIHPAFYDIWGQGTQVTVSSGGGGSGGGGSGGGGSGGGGSGGGGSGGGGSGGGGSEVQLVESGGGLVQAGGSLRLSCAASGRGFSPYTMGWFRQAPGKERVFVAGISWSTGIAHYTDSVKGRFTISRDNAKNTGSLQMNSLKPEDTAVYYCAVVQTTKGNYDYWGQGTQVTVSS

SEQ ID NO: 935 - protein, 282 aa, Artificial Sequence
  Nanobody
EVQLVESGGGLVQAGGSLSLSCATSGRTISDDTMAWFRQAPGKEREFVAIITFNGARTHYSDSVRDRFTISRDNAKNTVYLQMNSLKSEDTAVYYCAASTKYYSSTYNYIHPAFYDIWGQGTQVTVSSGGGGSGGGGSGGGGSGGGGSGGGGSGGGGSGGGGSEVQLVESGGDLVQTGGSLRLSCAASGITVSDRAMGWYRQAPGKQREMVAGVSRGGMTSYADSVKGRLTISRDNAKNSVYLQMNSLNPEDTAVYYCSAYYRYGSSVPQYWGQGTQVTVSS

SEQ ID NO: 936 - protein, 284 aa, Artificial Sequence
  Nanobody
EVQLVESGGGLVQAGGSLSLSCATSGRTISDDTMAWFRQAPGKEREFVAIITFNGARTHYSDSVRDRFTISRDNAKNTVYLQMNSLKSEDTAVYYCAASTKYYSSTYNYIHPAFYDIWGQGTQVTVSSGGGGSGGGGSGGGGSGGGGSGGGGSGGGGSGGGGSEVQLVESGGGLVQAGGSLRLSCAASGSIFSIKAMGWYRQAPGKQRELVARITSGGSTYYADSVKGRFTISRDNAKNTVYLQMNSLKPEDTAVFYCNAIVTDSDYDLGNDYWGQGTQVTVSS

SEQ ID NO: 937 - protein, 289 aa, Artificial Sequence
  Nanobody
EVQLVESGGGLVQAGGSLSLSCATSGRTISDDTMAWFRQAPGKEREFVAIITFNGARTHYSDSVRDRFTISRDNAKNTVYLQMNSLKSEDTAVYYCAASTKYYSSTYNYIHPAFYDIWGQGTQVTVSSGGGGSGGGGSGGGGSGGGGSGGGGSGGGGSGGGGSEVQLVESGGGLVQAGGSLRLSCAASGFAFDDYAIGWFRQAPGKEREGVSSISSSNGNTYYADSVRGRFTISSDNAKNTVYLQMNSLKPEDTGVYYCAAIWGIFFNEKMPVGAYDYWGQGTQVTVSS

SEQ ID NO: 938 - protein, 289 aa, Artificial Sequence
  Nanobody
EVQLVESGGGLVQAGGSLSLSCATSGRTISDDTMAWFRQAPGKEREFVAIITFNGARTHYSDSVRDRFTISRDNAKNTVYLQMNSLKSEDTAVYYCAASTKYYSSTYNYIHPAFYDIWGQGTQVTVSSGGGGSGGGGSGGGGSGGGGSGGGGSGGGGSGGGGSEVQLVESGGGLVEAGGSLRLSCAAAGRTLSSYSMAWFRQAPGKEREFVAIIRGNPSRTYHSDSVKGRFTASRDNAKNTVYLQMNRLEPEDTAVYYCAADPPPFASDYSAPQSYDYWGQGTQVTVSS

SEQ ID NO: 939 - protein, 273 aa, Artificial Sequence
  Nanobody
EVQLVESGGDLVQTGGSLRLSCAASGITVSDRAMGWYRQAPGKQREMVAGVSRGGMTSYADSVKGRLTISRDNAKNSVYLQMNSLNPEDTAVYYCSAYYRYGSSVPQYWGQGTQVTVSSGGGGSGGGGSGGGGSGGGGSGGGGSGGGGSGGGGSEVQLVESGGGLVQAGGSLRLSCAASGRGFSPYTMGWFRQAPGKERVFVAGISWSTGIAHYTDSVKGRFTISRDNAKNTGSLQMNSLKPEDTAVYYCAVVQTTKGNYDYWGQGTQVTVSS

SEQ ID NO: 940 - protein, 275 aa, Artificial Sequence
  Nanobody
EVQLVESGGDLVQTGGSLRLSCAASGITVSDRAMGWYRQAPGKQREMVAGVSRGGMTSYADSVKGRLTISRDNAKNSVYLQMNSLNPEDTAVYYCSAYYRYGSSVPQYWGQGTQVTVSSGGGGSGGGGSGGGGSGGGGSGGGGSGGGGSGGGGSEVQLVESGGGLVQAGGSLRLSCAASGSIFSIKAMGWYRQAPGKQRELVARITSGGSTYYADSVKGRFTISRDNAKNTVYLQMNSLKPEDTAVFYCNAIVTDSDYDLGNDYWGQGTQVTVSS

SEQ ID NO: 941 - protein, 280 aa, Artificial Sequence
  Nanobody
EVQLVESGGDLVQTGGSLRLSCAASGITVSDRAMGWYRQAPGKQREMVAGVSRGGMTSYADSVKGRLTISRDNAKNSVYLQMNSLNPEDTAVYYCSAYYRYGSSVPQYWGQGTQVTVSSGGGGSGGGGSGGGGSGGGGSGGGGSGGGGSGGGGSEVQLVESGGGLVQAGGSLRLSCAASGFAFDDYAIGWFRQAPGKEREGVSSISSSNGNTYYADSVRGRFTISSDNAKNTVYLQMNSLKPEDTGVYYCAAIWGIFFNEKMPVGAYDYWGQGTQVTVSS

SEQ ID NO: 942 - protein, 280 aa, Artificial Sequence
  Nanobody
EVQLVESGGDLVQTGGSLRLSCAASGITVSDRAMGWYRQAPGKQREMVAGVSRGGMTSYADSVKGRLTISRDNAKNSVYLQMNSLNPEDTAVYYCSAYYRYGSSVPQYWGQGTQVTVSSGGGGSGGGGSGGGGSGGGGSGGGGSGGGGSGGGGSEVQLVESGGGLVEAGGSLRLSCAAAGRTLSSYSMAWFRQAPGKEREFVAIIRGNPSRTYHSDSVKGRFTASRDNAKNTVYLQMNRLEPEDTAVYYCAADPPPFASDYSAPQSYDYWGQGTQVTVSS

SEQ ID NO: 943 - protein, 275 aa, Artificial Sequence
  Nanobody
EVQLVESGGGLVQAGGSLRLSCAASGSIFSIKAMGWYRQAPGKQRELVARITSGGSTYYADSVKGRFTISRDNAKNTVYLQMNSLKPEDTAVFYCNAIVTDSDYDLGNDYWGQGTQVTVSSGGGGSGGGGSGGGGSGGGGSGGGGSGGGGSGGGGSEVQLVESGGGLVQAGGSLRLSCAASGRGFSPYTMGWFRQAPGKERVFVAGISWSTGIAHYTDSVKGRFTISRDNAKNTGSLQMNSLKPEDTAVYYCAVVQTTKGNYDYWGQGTQVTVSS

SEQ ID NO: 944 - protein, 282 aa, Artificial Sequence
  Nanobody
EVQLVESGGGLVQAGGSLRLSCAASGSIFSIKAMGWYRQAPGKQRELVARITSGGSTYYADSVKGRFTISRDNAKNTVYLQMNSLKPEDTAVFYCNAIVTDSDYDLGNDYWGQGTQVTVSSGGGGSGGGGSGGGGSGGGGSGGGGSGGGGSGGGGSEVQLVESGGGLVQAGGSLRLSCAASGFAFDDYAIGWFRQAPGKEREGVSSISSSNGNTYYADSVRGRFTISSDNAKNTVYLQMNSLKPEDTGVYYCAAIWGIFFNEKMPVGAYDYWGQGTQVTVSS

SEQ ID NO: 945 - protein, 282 aa, Artificial Sequence
  Nanobody
EVQLVESGGGLVQAGGSLRLSCAASGSIFSIKAMGWYRQAPGKQRELVARITSGGSTYYADSVKGRFTISRDNAKNTVYLQMNSLKPEDTAVFYCNAIVTDSDYDLGNDYWGQGTQVTVSSGGGGSGGGGSGGGGSGGGGSGGGGSGGGGSGGGGSEVQLVESGGGLVEAGGSLRLSCAAAGRTLSSYSMAWFRQAPGKEREFVAIIRGNPSRTYHSDSVKGRFTASRDNAKNTVYLQMNRLEPEDTAVYYCAADPPPFASDYSAPQSYDYWGQGTQVTVSS

SEQ ID NO: 946 - protein, 278 aa, Artificial Sequence
  Nanobody
EVQLVESGGGLVQAGGSLRLSCTASGRTFTDYDMGWFRQAPGKEREVVAIIDTNGDNTLTVGSVKGRFAISSDNAKNTVYLQMNSLLPEDTAVYTCAAGAWSALRRSVANYWGQGTQVTVSSGGGGSGGGGSGGGGSGGGGSGGGGSGGGGSGGGGSEVQLVESGGGLVQAGGSLRLSCAASGSIFSIKAMGWYRQAPGKQRELVARITSGGSTYYADSVKGRFTISRDNAKNTVYLQMNSLKPEDTAVFYCNAIVTDSDYDLGNDYWGQGTQVTVSS

SEQ ID NO: 947 - protein, 284 aa, Artificial Sequence
  Nanobody
EVQLVESGGGLVQPGGSLRLSCAASGVTLDYYAIGWFRQAPGKEREGVSSISSNDGSTFYADSVKGRFTISRDKAKNTVYLQMNSLKPEDTAVYYCAATYLTAQAVGVPVAYYEFDYWGQGTQVTVSSGGGGSGGGGSGGGGSGGGGSGGGGSGGGGSGGGGSEVQLVESGGGLVQAGGSLRLSCAASGSIFSIKAMGWYRQAPGKQRELVARITSGGSTYYADSVKGRFTISRDNAKNTVYLQMNSLKPEDTAVFYCNAIVTDSDYDLGNDYWGQGTQVTVSS

SEQ ID NO: 948 - protein, 115 aa, Artificial Sequence [sequence omitted]

SEQ ID NO: 949 - protein, 115 aa, Artificial Sequence [sequence omitted]

SEQ ID NO: 950 - protein, 117 aa, Artificial Sequence
  Nanobody
AVQLVESGGGLVQGGGSLRLACAASERIFDLNLMGWYRQGPGNERELVATCITVGDSTNYADSVKGRFTISMDYTKQTVYLHMNSLRPEDTGLYYCKIRRTWHSELWGQGTQVTVSS

SEQ ID NO: 951 - protein, 35 aa, Artificial Sequence
  Linker sequence
GGGGSGGGGSGGGGSGGGGSGGGGSGGGGSGGGGS

SEQ ID NO: 952 - protein, 30 aa, Artificial Sequence
  Linker sequence
GGGGSGGGGSGGGGSGGGGSGGGGSGGGGS

SEQ ID NO: 953 - protein, 15 aa, Artificial Sequence
  Linker sequence
GGGGSGGGGSGGGGS

SEQ ID NO: 954 - protein, 9 aa, Artificial Sequence
  Linker sequence
GGGGSGGGS

SEQ ID NO: 955 - protein, 7 aa, Artificial Sequence
  Linker sequence
SGGSGGS

SEQ ID NO: 956 - protein, 12 aa, Artificial Sequence
  Linker sequence
EPKTPKPQPAAA

The invention claimed is:
1. An isolated Nanobody that binds to IL-6R and consists essentially of 4 framework regions (FR1 to FR4, respectively) and 3 complementarity determining regions (CDR1 to CDR3, respectively), in which:
   CDR1 consists essentially of the amino acid sequence of SEQ ID NO: 350;
   CDR2 consists essentially of the amino acid sequence of SEQ ID NO: 520; and
   CDR3 consists essentially of the amino acid sequence of SEQ ID NO: 690.
2. The Nanobody according to claim 1, that consists essentially of the amino acid sequence of SEQ ID NO: 180.
3. A composition comprising the Nanobody of claim 1.
4. The composition according to claim 3, which is a pharmaceutical composition.

* * * * *